US011174492B2

(12) United States Patent
Turgeman et al.

(10) Patent No.: US 11,174,492 B2
(45) Date of Patent: Nov. 16, 2021

(54) ISOLATED POLYNUCLEOTIDES AND POLYPEPTIDES ASSOCIATED WITH PLANTS RESISTANCE TO PATHOGENIC FUNGI

(71) Applicant: EVOGENE LTD., Rehovot (IL)

(72) Inventors: Tidhar Turgeman, Givatayim (IL); Ada Viterbo Fainzilber, Rehovot (IL); Eyal Emmanuel, Rehovot (IL)

(73) Assignee: EVOGENE LTD., Rehovot (IL)

( * ) Notice: Subject to any disclaimer, the term of this patent is extended or adjusted under 35 U.S.C. 154(b) by 0 days.

(21) Appl. No.: 16/477,982

(22) PCT Filed: Jan. 11, 2018

(86) PCT No.: PCT/IL2018/050044
§ 371 (c)(1),
(2) Date: Jul. 15, 2019

(87) PCT Pub. No.: WO2018/131037
PCT Pub. Date: Jul. 19, 2018

(65) Prior Publication Data

US 2019/0345511 A1 Nov. 14, 2019

Related U.S. Application Data

(60) Provisional application No. 62/446,546, filed on Jan. 16, 2017.

(51) Int. Cl.
*C12N 15/82* (2006.01)
*C07K 14/415* (2006.01)

(52) U.S. Cl.
CPC ........ *C12N 15/8282* (2013.01); *C07K 14/415* (2013.01)

(58) Field of Classification Search
None
See application file for complete search history.

(56) References Cited

U.S. PATENT DOCUMENTS

| | | | | |
|---|---|---|---|---|
| 9,359,615 | B2 | 6/2016 | Morel | |
| 9,485,994 | B2 | 11/2016 | Leveau | |
| 9,732,354 | B2 | 8/2017 | Thomma | |
| 2004/0214272 | A1 | 10/2004 | La Rosa | |
| 2007/0277269 | A1* | 11/2007 | Alexandrov ......... | C07K 14/415 800/290 |
| 2014/0115737 | A1 | 4/2014 | Abad | |

FOREIGN PATENT DOCUMENTS

WO 2006091219 A2 8/2006

OTHER PUBLICATIONS

Guo etal, 2004, Proc. Natl. Acad. Sci. USA 101: 9205-9210.*
Li et al (2015, MPMI 28:1237-1246).*
Schweiger et al, 2011, Gen Bank GU170355, https://www.ncbi.nlm.nih.gov/nuccore/GU170355.*
Uniprot UGT13_HORVV (2013, https://www.uniprot.org/uniprot/M0Y4P1).*
Brewer et al., (2014) Mutations in the Arabidopsis homoserine kinase gene DMR1 confer enhanced resistance to Fusarium culmorum and F. graminearum. BMC Plant Biol 14: 317; 15 pages.
Cheng et al., (2012) Structural and functional analysis of VQ motif-containing proteins in Arabidopsis as interacting proteins of WRKY transcription factors. Plant Physiol 159(2): 810-825.
Dowd and Johnson (2016) Maize peroxidase Px5 has a highly conserved sequence in inbreds resistant to mycotoxin producing fungi which enhances fungal and insect resistance. J Plant Res 129(1): 13-20.
Lai et al., (2011) Arabidopsis sigma factor binding proteins are activators of the WRKY33 transcription factor in plant defense. Plant Cell 23(10): 3824-3841.
Li et al., (2014) Comprehensive analysis of VQ motif-containing gene expression in rice defense responses to three pathogens. Plant Cell Rep 33(9): 1493-1505.
Li et al., (2015) Transgenic Wheat Expressing a Barley UDP-Glucosyltransferase Detoxifies Deoxynivalenol and Provides High Levels of Resistance to Fusarium graminearum. Mol Plant Microbe Interact 28(11): 1237-1246.
Mackintosh et al., (2007) Overexpression of defense response genes in transgenic wheat enhances resistance to Fusarium head blight. Plant Cell Rep 26(4): 479-488.
Perochon et al., (2015) TaFROG Encodes a Pooideae Orphan Protein That Interacts with SnRK1 and Enhances Resistance to the Mycotoxigenic Fungus Fusarium graminearum. Plant Physiol 169(4): 2895-2906.
Sasaki et al., (2016) The cold-induced defensin TAD1 confers resistance against snow mold and Fusarium head blight in transgenic wheat.Journal of Biotechnology. J Biotechnol, Accepted Manuscript; doi: http://dx.doi.org/doi:10.1016/j.biotec.2016.04.015; 15 pages.
Shin et al., (2008) Transgenic wheat expressing a barley class II chitinase gene has enhanced resistance against Fusarium graminearum. J Exp Bot 59(9): 2371-2378.
Tundo et al., (2016) Pyramiding PvPGIP2 and TAXI-III But Not PvPGIP2 and PMEI Enhances Resistance Against Fusarium graminearum. Mol Plant Microbe Interact 29(8): 629-639.
Wang et al., (2015) A comprehensive survey of the grapevine VQ gene family and its transcriptional correlation with WRKY proteins. Front Plant Sci 6: 417; 16 pages.

(Continued)

*Primary Examiner* — Anne Kubelik
(74) *Attorney, Agent, or Firm* — J.A. Lindeman & Co., PLLC

(57) ABSTRACT

The present invention relates to polynucleotides and polypeptides associated with increased resistance of plant to pathogenic fungi, particularly to fungi inducing root rot and stalk rot in plants, and use thereof for controlling plant fungal pathogens and for producing transgenic plants having increased resistance to pathogenic fungi.

2 Claims, 11 Drawing Sheets

Specification includes a Sequence Listing.

(56) References Cited

OTHER PUBLICATIONS

Zhu et al., (2012) Overexpression of wheat lipid transfer protein gene TaLTP5 increases resistances to Cochliobolus sativus and Fusarium graminearum in transgenic wheat. Fund Integr Genomics 12(3): 481-488.

Zuo et al., (2016) A Deoxynivalenol-Activated Methionyl-tRNA Synthetase Gene from Wheat Encodes a Nuclear Localized Protein and Protects Plants Against Fusarium Pathogens and Mycotoxins. Phytopathology 106(6): 614-623.

Database NCBI [Online] Jan. 10, 2009 (Jan. 10, 2009). Unknown [Zea mays] GenBank Accession No. ACL54126.1. URL: https://www.ncbi.nlm.nih.gov/protein/ACL54126?report=genbank&log$=protalign&blast_rank=1&RID=8SM8NJG201R. Jan. 10, 2009 (Jan. 10, 2009); 1 page.

* cited by examiner

FIG. 4A

TAACACAAGTGTCGAATAGGAAATTCACGAGCTGTCAAAAACCACATGAGGTT
TGTTTTTGACCCGCGACCGCGAGCTTGCTAACGCAAGGTTTCAGTTCTCGCCG
AAACGAAACAAAATGACGGTGCCGCGCTTGCGCTGTCATTTTTTTGTTTTCGA
CGGCCAGGCTGAAACTGTATGGCTGAGGATGTCACTGAGCTTCTTGTTTCCTA
GTGAAAATGGTAGAGAGCAGTTACTTGTTCACGTGAGAGAAGAAACTAAAGAG
AAAATAAATTAGCCTTTCTGCCTTTGTGACTGTTTTGAACTTTTGATATATAT
ATCCAGCCTTCCGCATGCTATATTTGAATCTCAATAAACGGTGCTAGGGGGGT
TTTAGCAAAAGTACTTCAATGTTCAATACTGTCTTAATAGACGTCCTTCTCTA
ACATCAAGGAGTACATTGCGTACGGGCCCTATTTATTTCGGTTTTTGGCTGTT
AGAATCGGCTTTTGGCAGCCAAATATTTTGTTTTTCAGATTGCTTACATGAGA
ATCGCGTCTGTAAAAATCGTCTAAATCAACGTTAATATAAAATCCTAAATTGT
GCAGAGCCCTCCACCTTTCTTAACACACAACACAGGTCTCAGGATATTCAAAT
CCATATAAGAGCTAGATTATTCAGTAGTCCAGATTCCGACCAAAACTCTTTAG
GATGCTATCACAAACAAACATGTCCATATTCTTTCGTGATTTTAACGTATCGT
TTTCGTGCCCTCTAACCAAAACACTCCCAAACTTGTTTTCGCTTTTCGAAAGG
AGGCTCGAAATTATGAAACTAAATTTTAGGAATAAAGACACAATTGCGACACA
AAAATAACCTTTTTTTACCCAACTTCACACCACCATATGTAGGTCTTCGTGCT
ACCGGATTTGCCAACACCTATAAAATTTATGTCAGGTTGTCACGGCTTTACTA
TTATCGCGTCTAACTTCAAACACATCTGGAGATGCATTGATCTCGC(SEQ ID NO:45)

FIG. 4B

GGAATACTTTGGCAAATTCTGCTCTGTCCTTGCAACCAAGCATAACATACAA
GTGACCGAAATAGACAAGCAAAGTATATCAGAACATTGTCAAATTGCAAGTT
GCAACAAAACTGAAGCAAACACAATGTAGAAACCATTCGGAGCATCACAGGG
GTTGGTAGCAATCTGAGATACATGATTAAAGGAATGGTTTAATAGTACATGC
ACAATTAAATGTTTCTTTTTGTTTCCAAGCTAGGCTATGAATTGTCCACGAT
CAAGCTAAAACCCCCTACCCACTAAACAGGAGACTGCTAGGCAGGGGCGAAC
AGGGAGCATTCCTGCATGTAAGCAACCAGCCAACCAAATCACAGCCATCTAT
CATTTCCTCTTCTTAGTAGGTGGTTGGGGGACATCATCGTCATCATCCTCTT
CCTCTTCTTCCTCCTCATCTTCCTCATTGTCACCATCCCCATCATCATCGTC
GTCATCATCCTCCTCTTCATCCTCTCCACCATCATCATCGTCGTCACTTCCT
CCTTCACCGTTGGCTGCAGGATCGTTATCATCGTCGTCGTCATCTTCCTCCT
CATTCCCATTGTCATCTGATCCCTCATCACCACCATCATCTTCTTGGTTTTC
AGCATCCTCATCGTCTCCCTCCTCATCATTATCATCATCAGACTCTCCATCA
TCCTTGTTCTCGAAATCAGTTGCATTTTTGTTTTTGCTCAGAATCCTTGTGG
AGAAGGAAACAAACAATCCTCAGCTTTGGGAGACGAAAAAAAATGCCCATGG
CAATAATGATGTGGTACATGTTTTGACATTATGCACCAGTGGGCATTACCTA
TTAATCAAATTCTGATCTCCACCAGATGTAAAGATTTCATTATGAAGAATCT
GCACAAGAAAGTCAAAACAGTACACAGTATTAGCTAAGACGAGGTATATTTC
CAATTAAAAGTGCACGAACAATGCAACAATGGTTATTCCCGGGCTTTAAAGG
ACATAAGACACG (SEQ ID NO:46)

FIG. 4C

AGATGCATTGATCTCGCGCG (SEQ ID NO:43)

FIG. 4D

AGATGCATTGATCTCGC (SEQ ID NO:47)

FIG. 4E

ATTTGCCAAAGTATTCCGGG (SEQ ID NO:44)

FIG. 4F

GGAATACTTTGGCAAAT (SEQ ID NO:48)

FIG. 4G

ATGGAGGTTTCCAGGTGGACCCCGGCGGCCGGCCTCCTGCTCCTGTTGCTCCTCC
CGCTCGCGGCCACCCCGTCACGCGCCGCCACGATGGCGAGATCGCCGTCGTCGTC
CACTGCCGTGTTCCAGCTCCAGGGAGACGTATACCCCACCGGCCACTACTATGTC
ACGATGAACATTGGGAACCCAGCGAAGCCCTACTTCCTGGACGTGGACACTGGCA
GCGATCTCACCTGGCTGCAGTGCGACGCACCCTGTCGGAGTTGCAACAAGGTGCC
ACATCCCTTGTATCGACCAACGGCAAACCGCCTTGTACCGTGTGCAAACGCACTC
TGCACTGCACTTCACAGCGGACAGGGCTCTAATAACAAGTGCCCTTCACCAAAAC
AATGCGACTATCAGATAAAGTACACCGACAGTGCATCTTCTCAGGGTGTGCTGAT
CAACGACAGCTTCTCACTGCCCATGAGATCCTCCAACATTCGTCCTGGCCTCACA
TTTGGCTGTGGATATGACCAGCAAGTGGGGAAAAATGGCGCTGTGCAGGCAGCGA
TTGACGGCATGCTTGGGCTCGGGAGGGGATCAGTTAGCCTTGTTTCACAGCTCAA
GCAGCAAGGGATCACCAAAAATGTCGTCGGCCATTGCCTAAGCACGAATGGAGGG
GGGTTCCTCTTCTTTGGGGATGATGTTGTGCCTTCATCACGTGTAACTTGGGTGC
CGATGGCTCAGAGGACATCTGGGAACTACTACTCACCTGGCTCAGGAACACTGTA
CTTCGATAGACGTTCACTAGGCGTGAAGCCAATGGAGGTGGTATTTGACAGTGGT
AGCACCTATACTTATTTTACTGCTCAACCATACCAAGCTGTTGTTTCTGCGCTCA
AAGGTGGTCTCAGCAAATCACTTAAACAGGTGTCAGATCCCACTCTGCCTCTGTG
CTGGAAAGGGCAGAAAGCATTCAAATCTGTGTTTGACGTCAAGAATGAATTCAAG
TCAATGTTTCTGAGCTTTGCCAGTGCCAAGAATGCCGCCATGGAGATCCCACCTG
AAAACTACCTCATTGTCACAAAAAATGGAAATGTGTGCCTGGGCATTCTTGATGG
AACGGCTGCCAAGCTGAGTTTCAACGTAATTGGAGACATCACGATGCAGGATCAG
ATGGTGATCTATGACAACGAGAAATCGCAGCTGGGATGGGCGCGTGGGGCATGCA
CTAGGAGCGCCAAGTCTATTCTGTCTTCCTTTCCCtga (SEQ ID NO:50)

FIG. 4H

TAACACAAGTGTCGAATAGGAAATTCACGAGCTGTCAAAAACCACATGAGGTTTG
TTTTTGACCCGCGACCGCGAGCTTGCTAACGCAAGGTTTCAGTTCTCGCCGAAAC
GAAACAAAATGACGGTGCCGCGCTTGCGCTGTCATTTTTTTGTTTTCGACGGCCA
GGCTGAAACTGTATGGCTGAGGATGTCACTGAGCTTCTTGTTTCCTAGTGAAAAT
GGTAGAGAGCAGTTACTTGTTCACGTGAGAGAAGAAACTAAAGAGAAAATAAATT
AGCCTTTCTGCCTTTGTGACTGTTTTGAACTTTTGATATATATATCCAGCCTTCC
GCATGCTATATTTGAATCTCAATAAACGGTGCTAGGGGGGTTTTAGCAAAAGTAC
TTCAATGTTCAATACTGTCTTAATAGACGTCCTTCTCTAACATCAAGGAGTACAT
TGCGTACGGGCCCTATTTATTTCGGTTTTTGGCTGTTAGAATCGGCTTTTGGCAG
CCAAATATTTTGTTTTTCAGATTGCTTACATGAGAATCGCGTCTGTAAAAATCGT
CTAAATCAACGTTAATATAAAATCCTAAATTGTGCAGAGCCCTCCACCTTTCTTA
ACACACAACACAGGTCTCAGGATATTCAAATCCATATAAGAGCTAGATTATTCAG
TAGTCCAGATTCCGACCAAAACTCTTTAGGATGCTATCACAAACAAACATGTCCA
TATTCTTTCGTGATTTTAACGTATCGTTTTCGTGCCCTCTAACCAAAACACTCCC
AAACTTGTTTTCGCTTTTCGAAAGGAGGCTCGAAATTATGAAACTAAATTTTAGG
AATAAAGACACAATTGCGACACAAAAATAACCTTTTTTTACCCAACTTCACACCA
CCATATGTAGGTCTTCGTGCTACCGGATTTGCCAACACCTATAAAATTTATGTCA
GGTTGTCACGGCTTTACTATTATCGCGTCTAACTTCAAACACATCTGG***AGATGCA
TTGATCTCGC***GCGCTTGAAAATTTAGTTATTAGGTTGGTAAAAGACTAGGTTAGG
TAAGAAATTTGAAAACAAAAATCCATGGGAGATGTTTTTACGTAGAAGAATAGTG
AGAATTTGAGAAACTTTATTTCCTAAGAAACAAAGAAAGTTTTGGTGAAATAATT
GAAACGAAAAATTCGAGAAACTAGAAGCCCGATAATGCCCTTCTCCTCTACCAAC
TACCAGCGCAGTCACTCGCCTCTGCACACGTCGCTGATGCTCGTCTTCCTTCCTT
CCCATCCTTTATAAGGCCCGGCCGCGGCTCTGCTCGCCTCTCCTCCCTTCCCTCC
CGTACCGTATCAGTCTCCCGGATTCTCTCCGGTTCGTGGGAGGGCCAAAGCTTCG
AGTTAGGAAAACCCTACCGCTGTGGGAGTAGCCTCCGGCG**atggaggtttccagg
tggaccccggcggccggcctcctgctcctgttgctcctcccgctcgcggccaccc
cgtcacgcgccgccacgatggcgagatcgccgtcgtcgtccactgccgtgttcca
gctccagggagacgtataccccaccggccactactatgtcacgatgaacattggg
aacccagcgaagccctacttcctggacgtggacactggcagcgatctcacctggc
tgcagtgcgacgcaccctgtcggagttgcaacaaggtgccacatcccttgtatcg
accaacggcaaaccgccttgtaccgtgtgcaaacgcactctgcactgcacttcac
agcggacagggctctaataacaagtgcccttcaccaaaacaatgcgactatcaga
taaagtacaccgacagtgcatcttctcagggtgtgctgatcaacgacagcttctc
actgcccatgagatcctccaacattcgtcctggcctcacatttggctgtggatat
gaccagcaagtggggaaaaatggcgctgtgcaggcagcgattgacggcatgcttg
ggctcgggaggggatcagttagccttgtttcacagctcaagcagcaagggatcac
caaaaatgtcgtcggccattgcctaagcacgaatggaggggggttcctcttcttt
ggggatgatgttgtgccttcatcacgtgtaacttgggtgccgatggctcagagga
catctgggaactactactcacctggctcaggaacactg**

FIG. 4H (Cont.)

tacttcgatagacgttcactaggcgtgaagccaatggaggtggtatttgacagtg
gtagcacctatacttatttactgctcaaccataccaagctgttgtttctgcgct
caaaggtggtctcagcaaatcacttaaacaggtgtcagatcccactctgcctctg
tgctggaaagggcagaaagcattcaaatctgtgtttgacgtcaagaatgaattca
agtcaatgtttctgagctttgccagtgccaagaatgccgccatggagatcccacc
tgaaaactacctcattgtcacaaaaatggaaatgtgtgcctgggcattcttgat
ggaacggctgccaagctgagtttcaacgtaattggagacatcacgatgcaggatc
agatggtgatctatgacaacgagaaatcgcagctgggatgggcgcgtggggcatg
cactaggagcgccaagtctattctgtcttcctttccctgaGCCAGCGAGAGACGC
AGGATAAAGGCCGTAGTTTTGCAAGGCGAGTAGAGCAGTATGTCAGTAATACAGC
ATCTATGGCATGTGCTTTTGCTCGTCCAGTTCATGAGCCCCGTTGTGTATTTGGT
TTCCGTTTTCTTGGTTGGAGTTTTTAGTTCCAAGGTCCGATCATGTTTTGATCCC
ATAAATTCTCTTCCAGCCTTCGAGCAACTGAGTCCATCTTCCTAAGTCATCAGCC
CCAGCGAGACATTGAAGCATGGGGAAACTTAAACAGTATGGTGATGATTAATCTC
AGCATTTTTTTTCTTGCAGCAATCAATATGGACTTTGCTTAAAATTTCGTTGTCT
TTTCAAAACGATATGCAAGCAAAATGGAAGTGATGTTCTTTGAAACTTTGTTTCA
ATGCTATAGCAAAGGTTTGCATTTTACAAAGTTCGGTTTAGTGACGACCATTTAG
ATGACATAGATTATGCTTTTCGTATTTTGGTAGCTTCTCGTGCGGACGCGCGGTC
ATGCCTAGCATGCCGAAGACCTTGTCATATAGTGAAAGGAATTGCGGTAGCAATT
AGTTCATTTTTCCCTAATCCCCTCCAATCACTTTCTCACCAAACAAACTCCAAAG
GTCGTCACCGAAGGGGGACGTTCCCGGAATACTTTGGCAAATTCTGCTCTGTCCT
TGCAACCAAGCATAACATACAAGTGACCGAAATAGACAAGCAAAGTATATCAGAA
CATTGTCAAATTGCAAGTTGCAACAAAACTGAAGCAAACACAATGTAGAAACCAT
TCGGAGCATCACAGGGGTTGGTAGCAATCTGAGATACATGATTAAAGGAATGGTT
TAATAGTACATGCACAATTAAATGTTTCTTTTTGTTTCCAAGCTAGGCTATGAAT
TGTCCACGATCAAGCTAAAACCCCCTACCCACTAAACAGGAGACTGCTAGGCAGG
GGCGAACAGGGAGCATTCCTGCATGTAAGCAACCAGCCAACCAAATCACAGCCAT
CTATCATTTCCTCTTCTTAGTAGGTGGTTGGGGGACATCATCGTCATCATCCTCT
TCCTCTTCTTCCTCCTCATCTTCCTCATTGTCACCATCCCCATCATCATCGTCGT
CATCATCCTCCTCTTCATCCTCTCCACCATCATCATCGTCGTCACTTCCTCCTTC
ACCGTTGGCTGCAGGATCGTTATCATCGTCGTCGTCATCTTCCTCCTCATTCCCA
TTGTCATCTGATCCCTCATCACCACCATCATCTTCTTGGTTTTCAGCATCCTCAT
CGTCTCCCTCCTCATCATTATCATCATCAGACTCTCCATCATCCTTGTTCTCGAA
ATCAGTTGCATTTTTGTTTTTGCTCAGAATCCTTGTGGAGAAGGAAACAAACAAT
CCTCAGCTTTGGGAGACGAAAAAAAATGCCCATGGCAATAATGATGTGGTACATG
TTTTGACATTATGCACCAGTGGGCATTACCTATTAATCAAATTCTGATCTCCACC
AGATGTAAAGATTTCATTATGAAGAATCTGCACAAGAAAGTCAAAACAGTACACA
GTATTAGCTAAGACGAGGTATATTTCCAATTAAAAGTGCACGAACAATGCAACAA
TGGTTATTCCCGGGCTTTAAAGGACATAAGACACG (SEQ ID NO:49)

FIG. 5A

GAGCCACCGGGAGTAGGCGC (SEQ ID NO:51)

FIG. 5B

GAGCCACCGGGAGTAGG (SEQ ID NO:52)

FIG. 5C

ATGGAGAAGAAGGCAGCTACTACAGAGGAACCCCTTCTCGCGCCGCGGTCCGAG
CACACGGTCGCGGCGGAGGCCAAGCGGCTGCTGAGCCTGGCGGGGCCGCTGGTG
GCCAGCTGCATCCTGCAGAACGTGGTCCAGCTGGTTTCCGTGATGTTCGTGGGC
CACCTCGGCGAGCTGCCCCTCGCCGGCGCGTCCCTGGCCAGCTCGCTCGCCAAC
GTCACCGGCTTCAGCCTCCTCGTGGGCATGGCGAGCGCGCTGGACACGCTGTGC
GGGCAGGCCTTCGGAGCGAGGCAGTACGGCCTGCTCGGCCTCTACAAGCAGCGG
GCCATGCTGGTGCTGGCGCTCGCCTGCGTCCCGATCGCCGCGGTCTGGGCCAAC
GCCGGGCGGATCCTCATCCTCCTCGGCCAGGACCGCGACATCGCCGCGGAGGCC
GGCGCCTACTCCCGGTGGCTCATACTGTCCCTGGTCCCCTACGTCCCGCTCGCG
TGCCACGTCCGGTTCCTGCAGACGCAGAGCATCGTCGTGCCGGTGATGGCCAGC
TCCGGCGCCACCGCGCTGGGCCACGTGCTGGTGTGCTGGGCGCTGGTGTTCAAG
GCCGGCATGGGGAGCAAAGGCGCCGCGCTGAGCGGTGCCATCTCCTACTCCGTC
AACCTGGCCATGCTGGCTCTCTACGTCAGGCTCTCCAGCGCGTGCAAGAGGACG
TGGACCGGATTCTCCACGGAGGCCTTCCGAGACCTTCTCCGGTTCACCGAGCTC
GCCGTCCCGTCGGCGATGATGGTCTGCTTGGAGTGGTGGTCCTTTGAACTGCTT
GTGCTTCTCTCTGGTCTGCTGCCCAATCCGAAGCTTGAAACCTCAGTACTGTCA
ATATGTCTAAACACTGGCGCCTTGCTGTTCATGGTGCCGTATGGTCTTTGCACA
GCCATAAGCACACGTGTTTCGAATGAGCTTGGTGCCGGCGAGCCTCAAGCAGCG
AGGCTAGCAGCTCGAGTGGTGATGTGCATCGCCCTGTCTGCAGGCTTGCTGCTC
GGCTCTACCATGATTCTCCTGCGCAGCTTCTGGGGCTACATGTACAGCAACGAA
CCTGAAGTCGTCACGTACATTGCTAGGATGATGCCGGTCCTGGCGATTTCGTTT
TTCACGGATGGGCTCCACAGTTGTCTATCAGGAGTGCTGACTGGGTGCGGTCGG
CAGAAGATTGGCGCGCGCGTCAATCTCGGTGCGTACTACTTGGCCGGCATTCCC
ATGGCCGTGCTGCTTGCATTTGTGCTTCACCTGAATGGAATGGGCCTGTGGCTT
GGCATCGTTTGTGGCAGCCTCACCAAGCTTGTGCTGCTCATGTGGATCACACTG
CGGATAAACTGGGAGAAAGAGGCAACCAACGCAAAAGAAACGGTGTTCAGTTCA
TCTCTTCCCGTAGCATTAtag (SEQ ID 53)

FIG. 5D

ATGGAGAAGAAGGCAGCTACTACAGAGGAACCCCTTCTCGCGCCGCGGTCC
GAGCACACGGTCGCGGCGGAGGCCAAGCGGCTGCTGAGCCTGGCGGGGCCG
CTGGTGGCCAGCTGCATCCTGCAGAACGTGGTCCAGCTGGTTTCCGTGATG
TTCGTGGGCCACCTCGGCGAGCTGCCCCTCGCCGGCGCGTCCCTGGCCAGC
TCGCTCGCCAACGTCACCGGCTTCAGCCTCCTCGTGGGCATGGCGAGCGCG
CTGGACACGCTGTGCGGGCAGGCCTTCGGAGCGAGGCAGTACGGCCTGCTC
GGCCTCTACAAGCAGCGGGCCATGCTGGTGCTGGCGCTCGCCTGCGTCCCG
ATCGCCGCGGTCTGGGCCAACGCCGGGCGGATCCTCATCCTCCTCGGCCAG
GACCGCGACATCGCCGCGGAGGCCGGCGCTACTCCCGGTGGCTCATACTGT
CCCTGGTCCCCTACGTCCCGCTCGCGTGCCACGTCCGGTTCCTGCAGACGC
AGAGCATCGTCGTGCCGGTGATGGCCAGCTCCGGCGCCACCGCGCTGGGCC
ACGTGCTGGTGTGCTGGGCGCTGGTGTTCAAGGCCGGCATGGGGAGCAAAG
GCGCCGCGCTGAGCGGTGCCATCTCCTACTCCGTCAACCTGGCCATGCTGG
CTCTCTACGTCAGGCTCTCCAGCGCGTGCAAGAGGACGTGGACCGGATTCT
CCACGGAGGCCTTCCGAGACCTTCTCCGGTTCACCGAGCTCGCCGTCCCGT
CGGCGATGATGGTCTGCTTGGAGTGGTGGTCCTTTGAACTGCTTGTGCTTC
TCTCTGGTCTGCTGCCCAATCCGAAGCTTGAAACCTCAGTACTGTCAATAT
GTCTAAACACTGGCGCCTTGCTGTTCATGGTGCCGTATGGTCTTTGCACAG
CCATAAGCACACGTGTTTCGAATGAGCTTGGTGCCGGCGAGCCTCAAGCAG
CGAGGCTAGCAGCTCGAGTGGTGATGTGCATCGCCCTGTCTGCAGGCTTGC
TGCTCGGCTCTACCATGATTCTCCTGCGCAGCTTCTGGGGCTACATGTACA
GCAACGAACCTGAAGTCGTCACGTACATTGCTAGGATGATGCCGGTCCTGG
CGATTTCGTTTTTCACGGATGGGCTCCACAGTTGTCTATCAGGAGTGCTGA
CTGGGTGCGGTCGGCAGAAGATTGGCGCGCGCGTCAATCTCGGTGCGTACT
ACTTGGCCGGCATTCCCATGGCCGTGCTGCTTGCATTTGTGCTTCACCTGA
ATGGAATGGGCCTGTGGCTTGGCATCGTTTGTGGCAGCCTCACCAAGCTTG
TGCTGCTCATGTGGATCACACTGCGGATAAACTGGGAGAAAGAGGCAACCA
ACGCAAAAGAAACGGTGTTCAGTTCATCTCTTCCCGTAGCATTAtag

(SEQ ID 54)

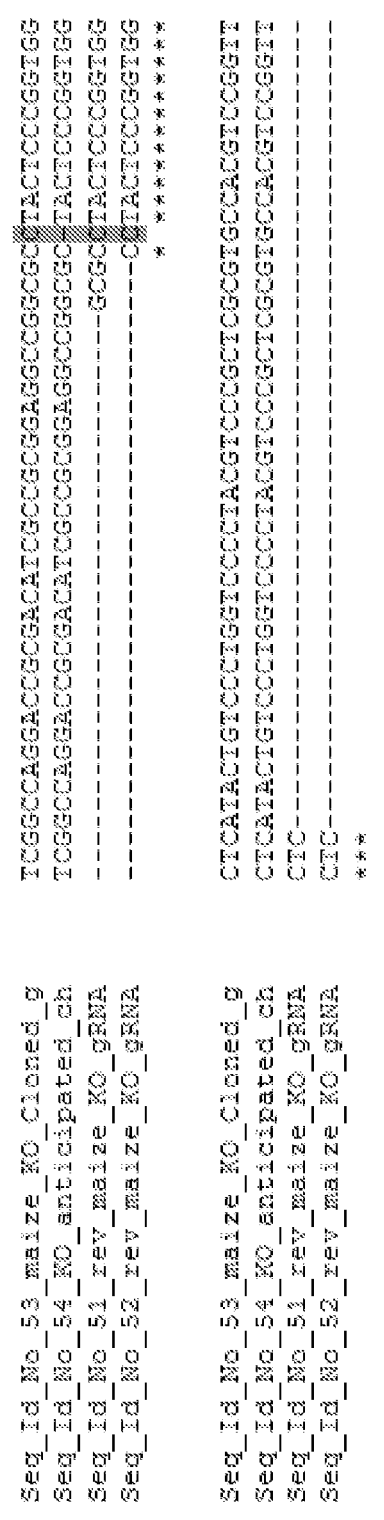

```
Seq_Id_No_53_maize_KO_Cloned_g      TCGGCCAGGACCGCGACATCGCCGCGGAGGCCGGCGCTTACTCCCGGTGG
Seq_Id_No_54_KO_anticipated_ch      TCGGCCAGGACCGCGACATCGCCGCGGAGGCCGGCGC-TACTCCCGGTGG
Seq_Id_No_51_rev_maize_KO_gRNA      ---------------------------------GCGCTTACTCCCGGTGG
Seq_Id_No_52_rev_maize_KO_gRNA      ------------------------------------CTTACTCCCGGTGG
                                                                        * ************

Seq_Id_No_53_maize_KO_Cloned_g      CTCATACTGTCCCTGGTCCCCTACGTCCCGCTCGCGTGCCACGTCCGGTT
Seq_Id_No_54_KO_anticipated_ch      CTCATACTGTCCCTGGTCCCCTACGTCCCGCTCGCGTGCCACGTCCGGTT
Seq_Id_No_51_rev_maize_KO_gRNA      CTC-----------------------------------------------
Seq_Id_No_52_rev_maize_KO_gRNA      CTC-----------------------------------------------
                                    ***
```

FIG. 5E

ISOLATED POLYNUCLEOTIDES AND POLYPEPTIDES ASSOCIATED WITH PLANTS RESISTANCE TO PATHOGENIC FUNGI

FIELD OF THE INVENTION

The present invention relates to polynucleotides and polypeptides associated with increased resistance of plants towards pathogenic fungi and/or Oomycetes, particularly to fungi inducing root rot and stalk rot in plants, and use thereof for controlling plant diseases associated with the fungal pathogens and for producing genetically engineered plants having increased resistance to the pathogenic fungi.

BACKGROUND OF THE INVENTION

During all developmental stages, plants are exposed to an extremely wide range of biotic and abiotic stress conditions leading to plant diseases. In the production of crop plants, damages caused by biotic stresses, particularly by pathogenic agents, which may be further enhanced under conditions of abiotic stress, pose a major problem and significantly affect the crop yield and profitability.

Many plant diseases are caused by plant pathogenic fungi, and damages to both monocotyledonous and dicotyledonous crop plants are of billions of US$ loss in yield in the U.S. only. For example, stalk rot, caused by a complex of *Fusarium* spp. and other fungi is one of the most serious challenges in maize production. At present, the majority of both inbreed and hybrid maize lines are susceptible. *Fusarium graminearum* (Fg) and *Fusarium verticillioides* (Fv) are the two main causal agents of stalk rot caused by *Fusarium* spp. in maize, but more than 10 additional *Fusarium* spp. can cause stalk rot. Natural infection is initiated by a mixture of the local *Fusarium* spp., but typically during the progress of the disease one species predominates. *Gibberella* stalk rot (caused by *Fusarium graminearum* Schwabe) is more prevalent in maize grown in cool regions; while *Fusarium* stalk rot (caused by *Fusarium verticillioides*) is most common in dry, warm regions. *Fusarium graminearum* and other *Fusarium* species are also responsible for *Fusarium* head blight (FHB) of wheat, which is a major disease problem for wheat and barley production worldwide, and for various root rots in wide range of different hosts. *Colletotrichum* spp. infects many grain crops such as barley, wheat, *sorghum* and corn. *C. graminicola* is one of the other major pathogens causing mainly maize stalk rots and being capable of infecting many other parts of the corn plant. It has been suggested that *C. graminicola* behaves as a wilt fungus which efficiently colonizes and moves through the fiber cells that surround the vascular bundles and underlie the epidermal cells in the stalk rind. Movement through the mostly non-living fibers may allow the fungus to avoid host defenses, providing a base from which it can invade adjacent parenchyma cells.

Powdery mildews are fungal diseases caused by different species of fungi in the order Erysiphales that affect a wide range of plants including cereals, grasses, vegetables, ornamentals, weeds, shrubs, fruit trees, broad-leaved shade and forest trees.

Traditionally, plant diseases have been controlled by agronomic practices that include crop rotation, the use of agrochemicals, and conventional breeding techniques. The use of chemicals to control plant pathogens, while being effective, increases the production costs, and moreover, is opposed to by the public and government regulators due to the increased awareness to the harmful effects of such chemicals on the ecosystem and animal health.

Upon the plant recognition of an agent as a pathogen, an array of biochemical responses is activated by the plant. As of today it is acknowledged that the initial plant response involves induction of several local responses in the cells immediately surrounding the infection site. In the hypersensitive response, cells contacted by the pathogen, and often neighboring cells, rapidly collapse and dry in a necrotic fleck. Other responses include the deposition of callose, the physical thickening of cell walls by lignification, and the synthesis of various antibiotic small molecules and proteins. Genetic factors in both the host and the pathogen determine the specificity of these local responses, which can be very effective in limiting the spread of infection.

Resistance to *Fusarium* is a polygenic trait and can be seen as consisting of two major components: (1) resistance to initial penetration, and (2) resistance to the spreading of the pathogen in host tissue. Though there is no evidence of complete resistance to *Fusarium* stalk rot in maize, genetic variation for resistance exists within maize germplasm. Resistance to *C. graminicola* is also primarily quantitative, although a few sources of major gene resistance have been described.

The constantly growing volume of research regarding the mechanisms involved in plant resistance to pathogens and the genetic basis of such mechanism, together with advances in biotechnology have presented new opportunities for protecting plants against pathogen infection through genetic engineering.

Many genes have been identified to participate in the plant defense mechanisms. For example, Sanghyun S et al. (2008. J Exp Bot. 2008:59(9):2371-8) showed that transgenic wheat expressing a barley class II chitinase exhibited enhanced resistance against *F. graminearum* in greenhouse and field conditions. Zhu X et al. (2012. Funct Integr Genomics. 12(3):481-488) described that overexpression of wheat lipid transfer protein gene TaLTP5 increases resistances to *Cochliobolus sativus* and *Fusarium graminearum* in transgenic wheat. Perochon A et al. (2015. Plant Physiol 169(4):2895-2906) reported the functional characterization of an orphan gene (*Triticum aestivum Fusarium* Resistance Orphan Gene [TaFROG]) as a component of resistance to *Fusarium* head blight (FHB). Zuo D Y et al. (2016. Phytopatol. 106(6):614-623) showed that a deoxynivalenol-activated methionyl-tRNA synthetase gene from wheat encodes a nuclear localized protein and protects plants against *Fusarium* pathogens infection and mycotoxins. Dowd P F and Johnson E T (2016. J Plant Res. 129(1):13-20) showed that the maize peroxidase Px5, the pericarp expression of which has been shown to be associated with resistance to *Aspergillus flavus* growth and to insects in a set of inbred plant lines has a highly conserved sequence which enhances fungal and insect resistance.

Many defense response genes are induced in wheat and other plants during *F. graminearum* infection and may play a role in reducing FHB. These response genes were thus investigated in an attempt to produce resistant wheat lines. Mackintosh C A et al. (2007. Plant Cell Rep 26(4):479-488) examined overexpression of the defense response genes alpha-1-purothionin, thaumatin-like protein 1 (tlp-1), and beta-1,3-glucanase in wheat, and reported that all the genes reduced at least part of the disease symptoms. A beta-1,3-glucanase transgenic line had enhanced resistance, showing lower FHB severity, deoxynivalenol (DON) mycotoxin concentration, and percent of visually scabby kernels (VSK) compared to a control plant. Sasaki K et al. (2016. J Biotechnol 228:3-7) also showed that overexpression of TAD1 (*Triticum aestivum* defensin 1), a protein induced during cold acclimation in winter wheat and encoding a plant defensin with antimicrobial activity, increased resistance against *Fusarium graminearum* in the transformed wheat plants.

Various additional genetic manipulation of gene expression for improving resistance to pathogenic fungi has also been reported. For example, Brewer H C et al. (2014. BMC Plant Biol 14(1):317) showed that mutations in the *Arabidopsis* homoserine kinase gene DMR1 confer enhanced resistance to *F. culmorum* and *F. graminearum*. Tundo S et al. (2016. Mol Plant Microbe Interact 29(8):629-639) produced transgenic plants with a combination of gene encoding proteins involved in inhibiting the activity of cell wall-degrading enzymes (CWDEs) secreted by pathogens to breach the plant cell-wall barrier. They showed that pyramiding polygalacturonase (PG) inhibiting protein (PGIP2) and TAXI-III, a xylanase inhibitor that controls the activity of xylanases, enhanced resistance against *Fusarium graminearum*, while pyramiding PGIP2 and pectin methyl esterase inhibitor (PMEI) did not reach the same effect. Li X et al. (2015. Mol Plant Microbe Interact 28(11):1237-1246) demonstrated that transgenic wheat expressing a barley UDP-glucosyltransferase detoxifies deoxynivalenol and provides high levels of resistance to *Fusarium graminearum*.

Among others, International Application Publication Nos. WO 2006/091219 and WO 2006/091219 disclose methods for protecting plants from plant pathogenic fungi by enhancing fungal pathogen resistance in a plant using the nucleotide sequences disclosed therein. Further disclosed therein are methods comprising introducing into a plant an expression cassette comprising a promoter operably linked to a nucleotide sequence that encodes an antifungal polypeptide as well as transformed plants, plant cells, seeds, and microorganisms comprising a nucleotide sequence that encodes an antifungal polypeptide or variant or fragment thereof.

U.S. Pat. No. 9,359,615 discloses plants which overexpress a p33 kD or BURP protein, or an ortholog thereof, and exhibit an increased pre-formed resistance to pathogens, particularly fungal pathogens.

U.S. Pat. No. 9,485,994 discloses methods and compositions for control of pathogenic fungal or Oomycetous infection. Particularly, the patent discloses an antifungal or an anti-Oomycetous composition comprising bacteria of the genus *Collimonas* and bacteria of the genus *Bacillus*, together exhibiting a synergistic antifungal or a synergistic anti-Oomycetous effect, and methods of use thereof.

U.S. Pat. No. 9,732,354 discloses new gene that is able to provide plants with resistance against pathogens, particularly *Verticillium, Ralstonia* or *Fusarium*. The gene is typical for Brassicaceae, but may confer resistance to other plants. Further provided are host cells with a nucleotide construct encoding the protein and methods for enhancing the pathogen resistance of plants.

However, as of today, there is an unmet need for further developed methods and compositions for protecting plants from fungal pathogen.

SUMMARY OF THE INVENTION

The present invention provides isolated polynucleotides, constructs comprising same and isolated polypeptides useful in conferring and/or enhancing resistance of a plant towards pathogenic fungi and/or Oomycetes. The present invention further provides genetically altered plants and plant cells with enhanced resistance to pathogenic fungi and/or Oomycetes as well as method for producing and selecting same.

According to one aspect, the present invention provides a method for enhancing the resistance of a plant or a part thereof to at least one pathogenic fungus and/or Oomycete, comprising modulating the expression and/or activity of at least one polypeptide at least 80% identical to a polypeptide having an amino acid sequence selected from the group consisting of SEQ ID NOs:571-939 within at least one cell of the plant or part thereof, thereby enhancing the resistance of said plant or part thereof to the at least one pathogenic fungus and/or Oomycete compared to the resistance of a control plant. Each possibility represents a separate embodiment of the present invention.

According to certain embodiments, the method comprises modulating the expression and/or activity of at least one polypeptide having the amino acid sequence selected from the group consisting of SEQ ID NOs:571-964. Each possibility represents a separate embodiment of the present invention.

According to certain embodiments, the at least one polypeptide is encoded by a polynucleotide comprising a nucleic acid sequence at least 80% identical to a nucleic acid sequence selected from the group consisting of SEQ ID NOs:55-527. Each possibility represents a separate embodiment of the present invention.

According to other embodiments, the at least one polypeptide is encoded by a polynucleotide comprising the nucleic acid sequence set forth in any one of SEQ ID NOs:55-564. Each possibility represents a separate embodiment of the present invention.

According to certain embodiments, enhancing the resistance of the plant or part thereof to the pathogenic fungus and/or Oomycete comprises enhancing the expression and/or activity of the at least one polypeptide compared to its expression and/or activity in the control plant.

According to certain exemplary embodiments, the polypeptide the expression and/or activity of which is to be enhanced comprises an amino acid sequence at least 80% identical to a polypeptide having an amino acid sequence selected from the group consisting of SEQ ID NOs: 573, 575-578, 585, 586, 589, 592-594, 600, 607, 609-611, 614, 629-632, 635, 641, 642, 645, and 651-654. Each possibility represents a separate embodiment of the present invention.

According to alternative exemplary embodiments, the polypeptide the expression and/or activity of which is to be enhanced comprises an amino acid sequence elected from the group consisting of SEQ ID NOs: 573, 575-578, 585, 586, 589, 592-594, 600, 607, 609-611, 614, 629-632, 635, 641, 642, 645, 651-654, 942, and 943. Each possibility represents a separate embodiment of the present invention.

Enhancing the polypeptide expression can be affected at the genomic and/or the transcript and/or translation level using a variety of methods that induce the transcription and/or translation of the polypeptide.

According to certain embodiments, enhancing the expression and/or activity of the polypeptide comprises expressing an exogenous polynucleotide encoding said at least one polypeptide within the at least one cell of the plant or the part thereof.

According to certain embodiments, enhancing the expression and/or activity of the polypeptide comprises transforming at least one cell of the plant or part thereof with an exogenous polynucleotide encoding the polypeptide, thereby producing a transgenic plant over-expressing said polypeptide.

Any method as is known in the art for introducing an exogenous polynucleotide into a plant cell can be used according to the teachings of the present invention. According to some embodiments, the exogenous polynucleotide is transformed into the plant cell using a suitable vector.

According to certain embodiments, the exogenous polynucleotide encodes an endogenous polypeptide of the at least one cell. According to other embodiments, the exogenous polynucleotide encodes a polypeptide heterologous to the at least one plant cell.

According to certain embodiments, genome editing is employed to edit the genome of the at least one cell as to express a heterologous polypeptide of the invention.

According to certain embodiments, the polynucleotide the expression of which is to be enhanced comprises a nucleic acid sequence at least 80% identical to a nucleic acid sequence selected from the group consisting of SEQ ID NOs:57, 59-62, 69, 70, 73, 76-78, 84, 91, 93-95, 98, 113-116, 119, 123, 125-128, 135, 136, 138, 141-143, 149, 156, 158-160, 162, 177-180, and 183. Each possibility represents a separate embodiment of the present invention.

According to other embodiments, the polynucleotide the expression of which is to be enhanced comprises the nucleic acid sequence set forth in one any one of SEQ ID NOs:57, 59-62, 69, 70, 73, 76-78, 84, 91, 93-95, 98, 113-116, 119, 123, 125-128, 135, 136, 138, 141-143, 149, 156, 158-160, 162, 177-180, 183, 530, 531, 535, and 536. Each possibility represents a separate embodiment of the present invention.

According to certain embodiments, enhancing the expression and/or activity of the polypeptide comprises modulating the expression of an endogenous polynucleotide encoding said polypeptide within the at least one cell of the plant or part thereof.

Modulating, according to certain embodiments enhancing, the expression of the endogenous polynucleotide can be affected at the genomic and/or the transcript level using a variety of methods that induce the transcription and/or translation of the polypeptide.

According to certain embodiments, enhancing the expression and/or activity of the endogenous polypeptide comprises subjecting the at least one cell of the plant or part thereof to genome editing using artificially engineered nucleases as is known in the art.

According to certain embodiments, isolated nucleic acids which serve as promoter or enhancer elements may be introduced in an appropriate position as to enhance transcription of the endogenous polynucleotide. According to some embodiments, the regulatory element is selected from the group consisting of, but not limited to, a promoter and an enhancer.

According to other embodiments, at least one mutation may be inserted within the endogenous polynucleotide as long as the mutation results in enhanced expression of the encoded polypeptide. Any method for mutagenesis as is known in the art can be used according to the teachings of the present invention including chemical mutagenesis, radio-mutagenesis and site directed mutagenesis, for example using genome editing techniques.

According to certain embodiments, enhancing the resistance of the plant to the pathogenic fungus and/or Oomycete comprises reducing the expression and/or activity of the at least one polypeptide compared to its expression and/or activity in the control plant. According to certain exemplary embodiments, the polypeptide the expression of which is to be reduced comprises an amino acid sequence at least 80% identical to an amino acid sequence selected from the group consisting of SEQ ID NOs:590, 603 and 619. According to certain exemplary embodiments, the polypeptide the expression of which is to be reduced comprises an amino acid sequence selected from the group consisting of SEQ ID NOs:590, 603 and 619.

According to certain embodiments, enhancing the resistance of the plant to the pathogenic fungus and/or Oomycete comprises reducing the expression of at least one polynucleotide compared to its expression and/or activity in the control plant. According to certain exemplary embodiments, the polynucleotide having reduced expression comprises a nucleic acid sequence at least 80% identical to a nucleic acid sequence selected from the group consisting of SEQ ID NOs:74, 87, 103, 139, 152, and 167. According to certain exemplary embodiments, the polynucleotide having reduced expression comprises a nucleic acid sequence selected from the group consisting of SEQ ID NOs:74, 87, 103, 139, 152, and 167.

Any method as is known in the art for reducing the expression and/or activity of a plant endogenous protein and the polynucleotide encoding same can be used according to the teachings of the resent invention.

According to certain embodiments, reducing the expression and/or activity of the polypeptide comprises down-regulating the expression of the endogenous polynucleotide encoding said polypeptide within the at least one cell of the plant or part thereof.

According to certain embodiments, reducing the expression and/or activity of the polypeptide comprises modulating the endogenous polynucleotide as to encode a non-functional polypeptide.

According to certain embodiments, expression of the polynucleotide is affected at the genomic and/or the transcript level using a variety of molecules that interfere with transcription and/or translation (e.g., antisense, siRNA, Ribozyme, or DNAzyme) of the polynucleotide. Inserting a mutation into the polynucleotide, including deletions, insertions, site specific mutations, mutations mediated by artificially engineered nucleases (including zinc-finger nucleases (ZFNs), transcription-activator like effector nucleases (TALENs) and CRISPR/Cas system) can be also used, as long as the mutations result in down-regulation of the gene expression or in the production of non-functional protein.

Alternatively, expression can be inhibited at the protein level using, e.g., antagonists, enzymes that cleave the polypeptide, and the like.

According to some embodiments, the control plant is a plant not manipulated to have modulated expression and/or activity of the polypeptide. According to some embodiments, the control plant is of the same species. According to some embodiments, the control plant comprises the same genetic background.

According to another aspect, the present invention provides a method for producing a population of plants each having an enhanced resistance to at least one pathogenic fungus and/or Oomycete, comprising the steps of:

(a) modulating the expression and/or activity of at least one polypeptide at least 80% identical to a polypeptide having an amino acid sequence selected from the group consisting of SEQ ID NOs:571-939 within at least one cell of each plant of a plant population as to produce a genetically engineered plant population;

(b) inoculating each plant of the genetically engineered plant population with the at least one pathogenic fungus and/or Oomycete; and (c) selecting plants showing an enhanced resistance to said at least one pathogenic fungus and/or Oomycete compared to a control plant or to a pre-determined resistance score value;

thereby producing a population of genetically engineered plants having enhanced resistance to said at least one pathogenic fungus and/or Oomycete.

According to certain embodiments, the method comprises modulating the expression and/or activity of at least one polypeptide having the amino acid sequence set forth in any one of SEQ ID NOs:571-964. According to certain embodiments, the method comprises modulating the expression and/or activity of at least one polypeptide having the amino acid sequence set forth in any one of SEQ ID NOs:571-977. According to other embodiments, the method comprises modulating the expression and/or activity of at least one polypeptide having the amino acid sequence set forth in any one of SEQ ID NOs:965-977. Each possibility represents a separate embodiment of the present invention.

The expression and/or activity of the at least polypeptide can be enhanced or reduced as described hereinabove.

According to certain embodiments, the method comprises modulating the expression of at least one polynucleotide comprising a nucleic acid sequence at least 80% identical to a nucleic acid sequence selected from the group consisting of SEQ ID NOs:55-527. According to some embodiments, the method comprises modulating the expression of at least one polynucleotide comprising a nucleic acid sequence selected from the group consisting of SEQ ID NOs:55-564. According to some embodiments, the method comprises modulating the expression of at least one polynucleotide comprising a nucleic acid sequence selected from the group consisting of SEQ ID NOs:528-564. According to some embodiments, the method comprises modulating the expression of at least one polynucleotide comprising a nucleic acid sequence selected from the group consisting of SEQ ID NOs:565-570. Each possibility represents a separate embodiment of the present invention.

The expression of the at least polypeptide and/or polynucleotide encoding same can be enhanced or reduced as described hereinabove.

According to certain embodiments, enhancing the expression comprises transforming the at least one cell of the plant or part thereof with a polynucleotide encoding at least one polypeptide at least 80% identical to a polypeptide having an amino acid sequence selected from the group consisting of SEQ ID NOs:573, 575-578, 585, 586, 589, 592-594, 600, 607, 609-611, 614, 629-632, 635, 641, 642, 645, and 651-654. Each possibility represents a separate embodiment of the present invention. According to certain embodiments, enhancing the expression comprises transforming the at least one cell of the plant or part thereof with a polynucleotide encoding at least one polypeptide comprising an amino acid sequence selected from the group consisting of SEQ ID NOs:573, 575-578, 585, 586, 589, 592-594, 600, 607, 609-611, 614, 629-632, 635, 641, 642, 645, 651-654, 942, and 943. Each possibility represents a separate embodiment of the present invention.

According to additional aspect, the present invention provides a method for selecting a plant having an enhanced resistance to at least one pathogenic fungus and/or Oomycete, comprising the steps of:

(a) providing a plurality of plants each comprising at least one cell with modulated expression and/or activity of a polypeptide at least 80% identical to a polypeptide having an amino acid sequence selected from the group consisting of SEQ ID NOs:571-939;

(b) inoculating the plurality of plants with the at least one pathogenic fungus and/or Oomycete; and (c) selecting plants showing an enhanced resistance to said at least one pathogenic fungus and/or Oomycete compared to a control plant or to a pre-determined resistance score value.

According to certain embodiments, the method comprises providing a plurality of plants each having a modulated expression and/or activity of at least one polypeptide having the amino acid sequence set forth in any one of SEQ ID NOs:571-977. Each possibility represents a separate embodiment of the present invention. According to other embodiments, the method comprises providing a plurality of plants each having a modulated expression and/or activity of a polypeptide having the amino acid sequence set forth in any one of SEQ ID NOs: 965-977. Each possibility represents a separate embodiment of the present invention.

According to certain embodiments, the modulated expression and/or activity is selected from enhanced expression and/or activity and reduced expression and/or activity. Modulating the expression can be performed by any method as is known in the art and as described hereinabove.

According to certain embodiments, the method comprises providing a plurality of plant each having modulated expression of at least one polynucleotide comprising a nucleic acid sequence at least 80% identical to a polynucleotide having the nucleic acid sequence set forth in any one of SEQ ID NOs:55-527. According to some embodiments, the at least one polynucleotide comprises a nucleic acid sequence selected from the group consisting of SEQ ID NOs:55-564. According to some embodiments, the at least one polynucleotide comprises a nucleic acid sequence selected from the group consisting of SEQ ID NOs:528-564. According to some embodiments, the at least one polynucleotide comprises a nucleic acid sequence selected from the group consisting of SEQ ID NOs:565-570. Each possibility represents a separate embodiment of the present invention.

According to certain embodiments, the control plant is a plant not manipulated to have modulated expression and/or activity of the polypeptide. According to some embodiments, the control plant is of the same species. According to some embodiments, the control plant comprises the same genetic background.

According to certain embodiments, the pre-determined resistance score value is obtained by a method comprising the steps of inoculating a plurality of corresponding plants susceptible to the at least one pathogenic fungus or Oomycete; scoring the infection degree; and setting an average resistance score value.

Modulating (enhancing or reducing) the expression and/or activity of the polypeptide can be achieved as described hereinabove and by any other method as is known in the art.

According to certain embodiments, the plant part is selected from the group consisting of seeds, roots, shoots, leaves, flowers and the like. Each possibility represents separate embodiment of the present invention. According to certain exemplary embodiments, the plant part is a root. Tissue cultures comprising cells derived from the plant having a modulated expression and/or activity of a polypeptide of the invention are also encompassed within the scope of the present invention.

According to additional aspect, the present invention provides a genetically engineered plant having enhanced resistance to at least one fungus and/or Oomycete compared to a non-engineered control plant, the genetically engineered plant comprising at least one cell having modified expression and/or activity of at least one polypeptide at least 80% identical to a polypeptide having an amino acid sequence selected from the group consisting of SEQ ID NOs:571-939 compared to the polypeptide expression and/or activity in the non-engineered control plant. Each possibility represents a separate embodiment of the present invention.

According to certain embodiments, the genetically engineered plant comprises at least one cell having modified expression and/or activity of at least one polypeptide having the amino acid sequence selected from the group consisting of SEQ ID NOs:571-964. Each possibility represents a separate embodiment of the present invention. According to certain embodiments, the genetically engineered plant comprises at least one cell having modified expression and/or activity of at least one polypeptide having the amino acid sequence selected from the group consisting of SEQ ID NOs:940-964. Each possibility represents a separate embodiment of the present invention.

According to certain embodiments, the genetically engineered plant comprises at least one cell having modified expression of at least one polynucleotide comprising a nucleic acid sequence at least 80% identical to a polynucleotide having the nucleic acid sequence set forth in any one of SEQ ID NOs:55-527. According to some embodiments, the at least one polynucleotide comprises a nucleic acid sequence selected from the group consisting of SEQ ID NOs:55-564. Each possibility represents a separate embodiment of the present invention.

According to certain exemplary embodiments, the genetically engineered plant having enhanced resistance to the at least one fungus and/or Oomycete comprises at least one cell having enhanced expression and/or activity of at least one polypeptide at least 80% identical to an amino acid sequence selected from the group consisting of SEQ ID NOs:573, 575-578, 585, 586, 589, 592-594, 600, 607, 609-611, 614, 629-632, 635, 641, 642, 645, and 651-654. According to some embodiments, the polypeptide having enhanced expression comprises an amino acid sequence selected from the group consisting of SEQ ID NOs:573, 575-578, 585, 586, 589, 592-594, 600, 607, 609-611, 614, 629-632, 635, 641, 642, 645, 651-654, 942, and 943. Each possibility represents a separate embodiment of the present invention.

According to certain exemplary embodiments, the genetically engineered plant having enhanced resistance to the at least one fungus and/or Oomycete comprises at least one cell having enhanced expression of at least one polynucleotide encoding a polypeptide at least 80% identical to a polypeptide having an amino acid sequence selected from the group consisting of SEQ ID NOs:573, 575-578, 585, 586, 589, 592-594, 600, 607, 609-611, 614, 629-632, 635, 641, 642, 645, and 651-654. According to some embodiments, the genetically engineered plant having enhanced resistance to the at least one fungus and/or Oomycete comprises at least one cell having enhanced expression of at least one polynucleotide encoding a polypeptide comprising the amino acid sequence selected from the group consisting of SEQ ID NOs: 573, 575-578, 585, 586, 589, 592-594, 600, 607, 609-611, 614, 629-632, 635, 641, 642, 645, 651-654, 942, and 943.

According to certain embodiments, the genetically engineered plant comprises at least one cell transformed with an exogenous polynucleotide encoding the at least one polypeptide having an amino acid sequence as set forth in any one of SEQ ID NOs:573, 575-578, 585, 586, 589, 592-594, 600, 607, 609-611, 614, 629-632, 635, 641, 642, 645, 651-654, 942, and 943 thereby having an enhanced resistance to the at least one fungus and/or Oomycete.

According to certain embodiments, the genetically engineered plant comprises at least one cell edited to overexpress a polynucleotide encoding the at least one polypeptide having an amino acid sequence as set forth in SEQ ID NOs:573, 575-578, 585, 586, 589, 592-594, 600, 607, 609-611, 614, 629-632, 635, 641, 642, 645, 651-654, 942, and 943, thereby having an enhanced resistance to the at least one fungus.

According to certain embodiments, the genetically engineered plant having enhanced resistance to the at least one fungus and/or Oomycete comprises at least one cell with enhanced expression of at least polynucleotide having a nucleic acid sequence selected from the group consisting of SEQ ID NOs:57, 59-62, 69, 70, 73, 76-78, 84, 91, 93-95, 98, 113-116, 119, 123, 125-128, 135, 136, 138, 141-143, 149, 156, 158-160, 162, 177-180, 183, 530, 531, 535, and 536. According to certain exemplary embodiments, the polynucleotide expression in the genetically engineered plant is enhanced in comparison to the polynucleotide expression in a control plant.

According to certain embodiments, the genetically engineered plant having enhanced resistance to the at least one fungus and/or Oomycete comprises at least one cell with reduced expression and/or activity of at least one polypeptide having an amino acid sequence selected from the group consisting of SEQ ID NOs:590, 603 and 619. Each possibility represents a separate embodiment of the present invention.

According to certain embodiments, the genetically engineered plant comprises a polynucleotide encoding a modified form of the at least one polypeptide, wherein the modified form has reduced or no activity compared to the unmodified form, thereby having an enhanced resistance to the at least one fungus.

According to certain embodiments, the genetically engineered plant having reduced expression and/or activity of the at least one polypeptide comprises at least one cell having reduced expression of a polynucleotide having a nucleic acid sequence selected from the group consisting of SEQ ID NOs:74, 87, 103, 139, 152, and 167. Each possibility represents a separate embodiment of the present invention.

According to additional aspect, the present invention provides an isolated polynucleotide encoding a polypeptide comprising an amino acid sequence at least 80% identical to an amino acid sequence selected from the group consisting of SEQ ID NOs: 573, 575-578, 585, 586, 589, 592-594, 600, 607, 609-611, 614, 629-632, 635, 641, 642, 645, and 651-654, wherein the polypeptide, when expressed in a plant, is capable of enhancing the resistance of the plant to at least one pathogenic fungus and/or Oomycete.

According to certain embodiments, the polynucleotide encodes a polypeptide comprising the amino acid sequence set forth in any one of SEQ ID NOs: 573, 575-578, 585, 586, 589, 592-594, 600, 607, 609-611, 614, 629-632, 635, 641, 642, 645, 651-654, 942, and 943.

According to certain embodiments, the polynucleotide comprises a nucleic acid sequence at least 80% identical to a nucleic acids sequence set forth in any one of SEQ ID NOs:57, 59-62, 69, 70, 73, 76-78, 84, 91, 93-95, 98, 113-116, 119, 123, 125-128, 135, 136, 138, 141-143, 149, 156, 158-160, 162, 177-180, and 183. According to other embodiments, the polynucleotide comprises the nucleic acid sequence set forth in any one of SEQ ID NOs:57, 59-62, 69, 70, 73, 76-78, 84, 91, 93-95, 98, 113-116, 119, 123, 125-128, 135, 136, 138, 141-143, 149, 156, 158-160, 162, 177-180, 183, 530, 531, 535, and 536.

According to yet another aspect, the present invention provides an isolated polynucleotide, a fragment or a mutant thereof, the polynucleotide comprising a nucleic acid sequence at least 80% identical to a nucleic acids sequence selected from the group consisting of SEQ ID NOs: 57, 59-62, 69, 70, 73, 76-78, 84, 91, 93-95, 98, 113-116, 119, 123, 125-128, 135, 136, 138, 141-143, 149, 156, 158-160, 162, 177-180, and 183, wherein said polynucleotide, when expressed in a plant, is capable of enhancing the resistance of the plant to at least one pathogenic fungus and/or Oomycete. According to certain embodiments, the polynucleotide comprises the nucleic acid sequence set forth in any one if SEQ ID NOs:57, 59-62, 69, 70, 73, 76-78, 84, 91, 93-95, 98, 113-116, 119, 123, 125-128, 135, 136, 138, 141-143, 149, 156, 158-160, 162, 177-180, 183, 530, 531, 535, and 536.

According to additional aspect, the present invention provides a nucleic acid construct comprising a polynucleotide according to some embodiments of the present invention, further comprising at least one regulatory element for directing the expression of the polynucleotide within a plant cell. According to certain embodiment, the regulatory element is a promoter. The promoter can be endogenous or heterologous to the plant comprising the nucleic acid construct.

The polypeptides and polynucleotides disclosed herein may be used to confer resistance to a wide variety of fungal and Oomycetous pathogens that cause commercial damage to crop and ornamental plants.

According to certain embodiments, the fungal or Oomycetous pathogens can be one or more fungi or Oomycetes from a class selected from the group consisting of Plasmodiophoromycetes, Chytridiomycetes, Zygomycetes, Ascomycetes, Basidiomycetes, Deuteromycetes, and Sordariomycetes. Each possibility represents a separate embodiment of the present invention.

According to some embodiments, the fungal pathogens can be one or more fungi from a genus selected from the group consisting of *Fusarium, Colletotrichum, Geotrichum, Aspergillus, Alternaria, Athelia, Botryosphaeria, Botrytis, Cryphonectria, Choanephora, Cercospora, Magnaporthe Monilinia, Mycosphaerella, Melampsora, Puccinia, Phakopsora, Rhizoctonia, Septoria, Uromyces, Ustilago* and *Verticillium*.

According to some embodiments, the Oomycetous pathogen can be from the class Oomycetes (synonym Peronosporomycetes). In some embodiments, said Oomycetous infection comprises infection by an Oomycete from a genus selected from the group consisting of *Blumeria, Macrophomina, Oidium, Pythium*, and *Phytophthora*. Each possibility represents a separate embodiment of the present invention. According to some embodiments, the fungal or Oomycetous pathogen is selected from the group consisting of *Botrytis cinerea Mycosphaerella graminicola, Mycosphaerella fijiensis, Septoria lycopersici, Magnaporthe oryza, Rhizoctonia solani, Ustilago maydis, Sclerotium rolfsii*, and *Blumeria graminis*.

According to certain exemplary embodiments, the fungus of the genus *Fusarium* is selected from the group consisting of *Fusarium verticilloides* and *Fusarium graminearum*. According to additional exemplary embodiments, the *F. verticilloides* is *F. verticillioides* strain A-00149-FGSC 7600. According to further exemplary embodiments, the *F. graminearum* is *F. graminearum* strain CBS 110260.

According to other exemplary embodiments, the fungus of the genus *Colletotrichum* is *Colletotrichum graminicola*.

The polynucleotides and polypeptides of the present invention can be used to confer resistance to any plant type.

According to certain embodiments, the plant is a cereal plant. According to some embodiments, the cereal plant is selected from the group consisting of wheat, barley, *sorghum*, maize, rice, oat, and rye. Each possibility represents a separate embodiment of the present invention. According to other embodiments, the plant is a field-crop plant. According to some embodiments, the field crop plant is selected from the group consisting of tomato, potato, sweet potato, cassava, beets, ginger, horseradish, radish, *ginseng*, turnip, any root or tuber crop, pepper, eggplant, ground cherry, tomatillo, okra, other fruiting vegetables, cucumber cantaloupe, melon, muskmelon, squash, watermelon and other cucurbit plants.

Further embodiments and the full scope of applicability of the present invention will become apparent from the detailed description given hereinafter. However, it should be understood that the detailed description and specific examples, while indicating preferred embodiments of the invention, are given by way of illustration only, since various changes and modifications within the spirit and scope of the invention will become apparent to those skilled in the art from this detailed description.

BRIEF DESCRIPTION OF THE FIGURES

FIGS. 4A-H depict an exemplary design of Homology Directed Repair according to some embodiments of the invention. FIG. 4A depicts the sequence of the endogenous 5'-upstream flanking region of the genomic sequence GRMZM2G069095 (SEQ ID NO:45). FIG. 4B depicts the sequence of the endogenous 3'-downstream flanking region of the genomic sequence GRMZM2G069095 having the nucleic acid sequence set forth in SEQ ID NO:46. FIG. 4C depicts the sequence of the 5'-UTR sgRNA (SEQ ID NO:43). FIG. 4D depicts the sequence of the 5'-UTR gRNA without NGG nucleotides (SEQ ID NO:47). FIG. 4E depicts the sequence of the 3'-UTR gRNA (SEQ ID NO:44). FIG. 4F depicts the sequence of the 3'-UTR gRNA after cut (SEQ ID NO:48). FIG. 4G depicts the coding sequence (from the "ATG" start codon to the "TGA" termination codon, marked by bold and underlined) of the desired LFS24 sequence (SEQ ID NO:50) encoding the polypeptide set forth by SEQ ID NO:589. FIG. 4H depicts the exemplary repair template (SEQ ID NO: 49) which includes (1) the upstream flanking region (1 kbp) sequence including part of the gRNA after cutting (SEQ ID NO:47; shown in bold and italics); (2) 5' UTR of genomic DNA from Cas9 cutting site to ATG; (3) the coding sequence (CDS) of the desired LFS24 sequence (SEQ ID NO:50) marked in lower case with the start (ATG) and the stop (TGA) codons marked in bold and underlined; (4) 3' UTR of genomic DNA from the stop codon to Cas9 cutting site including the predicted part of the gRNA after cutting (SEQ ID NO:48, shown in bold and underlined and (5) the downstream flanking region (1 kbp) sequence.

FIG. 5A-E depicts an exemplary design of polynucleotide knockout (KO) using CRISPR/CAS system. FIG. 5A depicts the sequence of the KO gRNA (SEQ ID NO:51); FIG. 5B depicts the sequence of the KO gRNA (SEQ ID NO:52); FIG. 5C depicts the coding sequence (from the "ATG" start codon to the "TAG" termination codon, marked by bold and underlined) of the desired LFS39 sequence (SEQ ID NO:53); FIG. 5D (targeted region in bold) and FIG. 5E depict the anticipated change in the coding sequence of the exemplified KO gene (SEQ ID NO:54).

DETAILED DESCRIPTION OF THE INVENTION

Figure 1A:
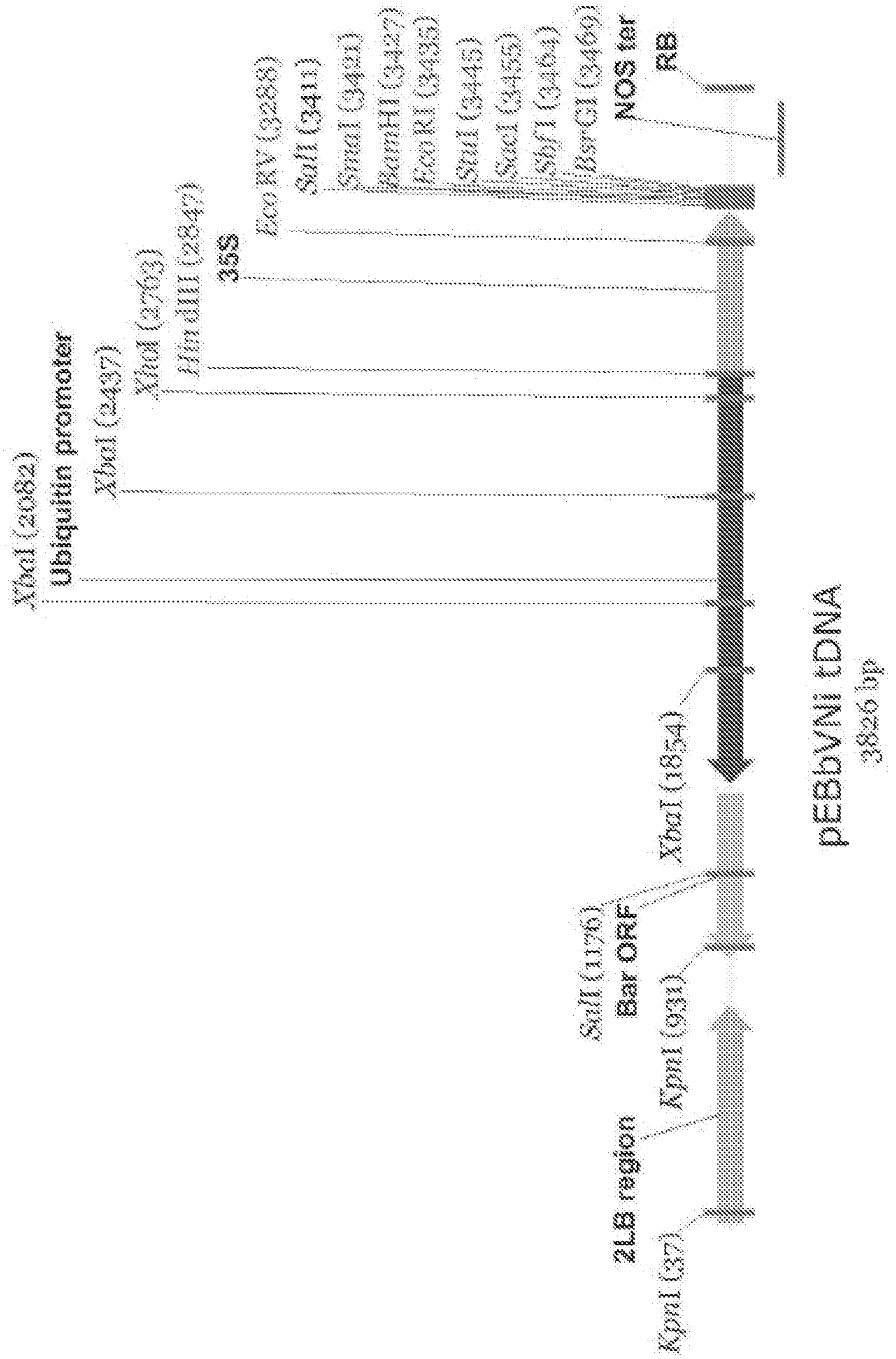
FIG. 1 shows a schematic illustration of the tDNA plasmids used in *Brachypodium* experiments. pEBbVNi tDNA (FIG. 1A) was used for expression of the isolated polynucleotide sequences of some embodiments of the invention in *Brachypodium*. pEBbNi tDNA (FIG. 1B) was used for transformation into *Brachypodium* as a negative control. "RB"=right border; "2LB region"=2 repeats of left border; "35S"=35S promoter (SEQ ID NO:37 in FIG. 1A); "Ubiquitin promoter" SEQ ID NO:11 in both of FIGS. 1A and 1B; "NOS ter"=nopaline synthase terminator; "Bar ORF"— BAR open reading frame (GenBank Accession No. JQ293091.1; SEQ ID NO:38); The isolated polynucleotide sequences of some embodiments of the invention were cloned into the Multiple cloning site of the vector using one or more of the indicated restriction enzyme sites.
Figure 1B:
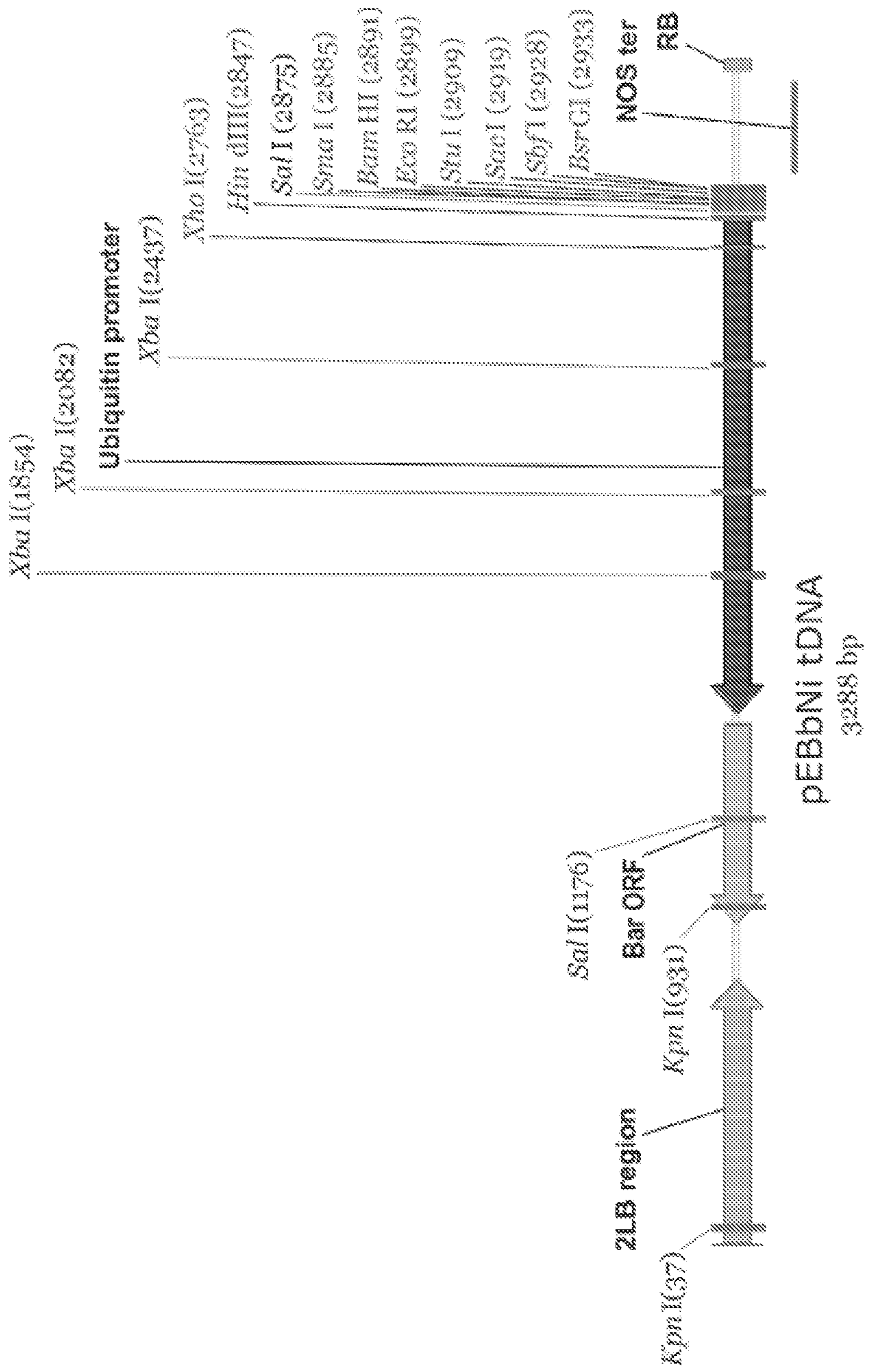

The present invention discloses means and methods for conferring and/or enhancing the resistance of a plant to pathogenic fungi and/or Oomycetes. Particularly, the present invention provides isolated polypeptides conferring or enhancing plant resistance to pathogenic fungi and/or Oomycetes, isolated polynucleotides encoding same, nucleic acid constructs comprising the polynucleotides and plant cells transformed with same and methods for producing and selecting plants having increased resistance to at least one pathogenic fungus and/or Oomycete and plant with enhanced resistance to the at least one pathogenic fungus and/or Oomycete.

The present invention is based in part on bioinformatics tools that have been used to identify polynucleotides associated with resistance or reduced sensitivity of plants to at least one pathogenic fungus or pathogenic Oomycete. Cereal plants, including maize (*Zea*), *Sorghum*, wheat (*Triticum*) and barley (*Hordeum*) were used as representative genera to identify genes overexpressed or downregulated in plants showing increased resistance to fungal/Oomycetes infection, and genes comprising the nucleic acids sequence set forth in any one of SEQ ID NOs:55-120, 528-532, and 565, encoding polypeptides having the amino acid sequence set forth in any one of SEQ ID NOs:577-636, 940-942, and 966-977 were identified. Homologous genes and encoded proteins were also identified in wider genera of plant, as described in details and presented in Table 2 hereinbelow. Polynucleotides according to some embodiments of the present invention were cloned into binary vectors (Example 5, Table 13), and further transformed into plants of the species *Brachypodium distachyon* (Example 6 hereinbelow) to further validate the effect of the genes on the resistance of the transformed plants towards the fungi/Oomycetes.

Definitions

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible sub ranges as well as individual numerical values within that range. For example, description of a range such as from 1 to 6 should be considered to have specifically disclosed sub ranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the agricultural, chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

As used herein, the phrase "exogenous polynucleotide" refers to a heterologous nucleic acid sequence which is not naturally expressed within the plant (e.g., a nucleic acid sequence from a different species) or to an endogenous nucleic acid of which overexpression in the plant is desired. The exogenous polynucleotide may be introduced into the plant in a stable or transient manner, so as to produce a ribonucleic acid (RNA) molecule and/or a polypeptide molecule.

The term "endogenous" as used herein refers to a polynucleotide or polypeptide which is naturally present and/or naturally expressed within a plant or a cell thereof.

The term "heterologous" as used herein refers to polynucleotide or polypeptide which is not naturally present and/or naturally expressed within a plant or a cell thereof.

The terms "modulating", "modifying" and "altering" with reference to the expression or activity of a polynucleotide, gene, polypeptide or a protein within a cell or a plurality of cells, particularly plant cell(s), are used herein interchangeably and refer to changing their level of within the cell, particularly plant cell. The change can be an increase or a decrease; and it can be measured as compared to any one of the polynucleotide, gene, polypeptide or and protein level within the same cell(s) before modulation and as compared to the level in a control plant or an average level from a plurality of control plants in which the expression was not modified by man.

According to certain embodiments, the control plant is a wild type plant not manipulated to have modulated expression and/or activity of the polypeptide. According to some embodiments, the control plant is of the same species. According to some embodiments, the control plant comprises the same genetic background.

According to certain embodiments, the examined plant and the control plant are grown under the same growing conditions.

As used herein, the term "resistance" with regard to plants pathogenic fungus and/or Oomycete refers to a plant that is resistant to infection by a fungal or Oomycetous pathogen or resistant to the symptoms of fungal or Oomycetous pathogen infection. For example, a plant resistant to a fungal or Oomycetous pathogen can exhibit a lack of infection, or reduced symptoms of infection, when challenged with a pathogen. As another example, a plant resistant to a fungal or Oomycetous pathogen can be infected by the fungal or Oomycetous pathogen and yet exhibit a reduced number or degree of symptoms of said infection. As yet another example, a plant resistant to a fungal or Oomycetous pathogen can be infected by the pathogen and exhibit one or more symptoms of infection by the pathogen and yet exhibit a reduction in an effect of the infection or symptom thereof. For instance, a plant resistant to a fungal or Oomycetous pathogen can be infected by the pathogen, and exhibit one or more symptoms selected from the group consisting of leaf wilt, leaf or vascular discoloration (e.g., yellowing), spike bleaching etc., and yet exhibit a reduction in yield loss in comparison to a plant that is not resistant to the fungal or Oomycetous pathogen.

Accordingly, "confer resistance to a pathogenic fungus and/or Oomycete" or "enhanced resistance to a pathogenic fungus and/or Oomycete" refer to a phenotype in which a plant has greater health, growth, multiplication, fertility, vigor, strength (e.g., lodging resistance), yield, or less severe symptoms associated with infection of the pathogenic fungus or Oomycete during or after a fungal or Oomycete infection than an organism that does not have enhanced resistance to the pathogen. Where a plant is tested for resistance, a control plant is used to assess the degree of the plant resistance. According to certain embodiments of the present invention, the control plant is a plant not manipulated to have modified expression of at least one polypeptide of the present invention. The control plant is typically, but not necessarily of the same species as the examined plant. According to some embodiments the control plant is of the same specifies and has the same genetic background as the examined plant. The enhancement can be an increase of 0.1%, 0.2%, 0.3%, 0.5%, 0.75%, 1%, 1.5%, 2%, 3%, 4%, 5%, 6%, 7%, 8%, 9%, 10%, 12%, 15%, 17%, 20%, 25%, 30%, 35%, 40%, 50%, 60%, 70%, 80%, 90%, 100%, or more in health, growth, multiplication, fertility, vigor, strength (e.g., lodging resistance), or yield, as compared to a control plant. The enhancement can be a decrease of 0.1%, 0.2%, 0.3%, 0.5%, 0.75%, 1%, 1.5%, 2%, 3%, 4%, 5%, 6%, 7%, 8%, 9%, 10%, 12%, 15%, 17%, 20%, 25%, 30%, 35%, 40%, 50%, 60%, 70%, 80%, 90%, or 100% in the symptoms associated with the pathogenic fungus and/or Oomycete as compared to the control plant. According to certain exemplary embodiments, the examined plant and the control plant are grown under the same conditions.

According to certain embodiments of the invention, enhancing the resistance of a plant to a pathogenic fungus comprises enhancing the expression and/or activity of a polypeptide of the invention within at least one cell of the plant. As used herein, the expression of a polynucleotide or polypeptide of the invention is "enhanced" or "upregulated" if the level of the polynucleotide or polypeptide is enhanced by at least 50%, i.e. the polynucleotide or polypeptide level is at least 1.5 fold higher compared to its level in a control plant or compared to a predetermined threshold level. According to some embodiments, the level of the polynucleotide or polypeptide is enhanced by at least 60%, 70%, 80%, 90%, 100%, 200%, 300% and more.

According to certain embodiments, the pre-determined resistance score value is obtained by inoculating a population of corresponding plants susceptible to the at least one pathogenic fungus, scoring the infection degree and setting an average resistance score value.

According to certain embodiments of the invention, enhancing the resistance of a plant to a pathogenic fungus comprises reducing the expression and/or activity of a polypeptide of the invention within at least one cell of the plant. As used herein, the expression of a polynucleotide or polypeptide of the invention is "reduced", "inhibited", "down regulated" or "knocked out" or "knocked down" if the level of the polynucleotide or polypeptide is reduced by at least 30% compared to its level in a control plant or compared to a predetermined threshold level. According to certain embodiments, the level of the polynucleotide or polypeptide is reduced by at least 40%, 50%, 60%, 70%, 80%, 90% and more. According to some embodiments, the term "reduced expression" refers to 100% inhibition or "knockout" of a polynucleotide function and/or expression.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

The term "isolated" refers to at least partially separated from the natural environment e.g., from a plant cell.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

It should be noted that the nucleic acid sequence of a polynucleotide encoding a polypeptide which is provided in the sequence listing as a single strand refers to the sense direction which is equivalent to the mRNA transcribed from the polynucleotide.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

As used herein, the phrase "exogenous polynucleotide" refers to a heterologous nucleic acid sequence which is not naturally expressed within the plant (e.g., a nucleic acid sequence from a different species) or to an endogenous nucleic acid of which overexpression in the plant is desired. The exogenous polynucleotide may be introduced into the plant in a stable or transient manner, so as to produce a ribonucleic acid (RNA) molecule and/or a polypeptide molecule.

The term "endogenous" as used herein refers to a polynucleotide or polypeptide which is naturally present and/or naturally expressed within a plant or a cell thereof.

The term "heterologous" as used herein refers to polynucleotide or polypeptide which is not naturally present and/or naturally expressed within a plant or a cell thereof.

According to one aspect, the present invention provides a method for enhancing the resistance of a plant or a part thereof to at least one pathogenic fungus and/or Oomycete, comprising modulating the expression and/or activity of at least one polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs:571-939 within at least one cell of the plant or part thereof, thereby enhancing the resistance of said plant or part thereof to the at least one pathogenic fungus and/or Oomycetes compared to the resistance of a control plant. Each possibility represents a separate embodiment of the present invention.

According to another aspect, the present invention provides a method for enhancing the resistance of a plant or a part thereof to at least one pathogenic fungus and/or Oomycete, comprising modulating the expression of at least one polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs:571-939 within at least one cell of the plant or part thereof, thereby enhancing the resistance of said plant or part thereof to the at least one pathogenic fungus and/or Oomycete compared to the resistance of a corresponding control plant. Each possibility represents a separate embodiment of the present invention.

According to certain embodiments, the polypeptide is 80%-99% homologous to any one of the polypeptides set forth in SEQ ID NOs:571-939. According to other embodiments, the polypeptide is 85%-95% homologous to any one of the polypeptides set forth in SEQ ID NOs:571-939. According to other embodiments, the polypeptide is 90%-99% homologous to any one of the polypeptides set forth in SEQ ID NOs:571-939. According to certain embodiments, the polypeptide comprises an amino acid sequence selected from the group consisting of SEQ ID NOs:571-964. Each possibility represents a separate embodiment of the present invention. According to certain embodiments, the polypeptide consists of the amino acid sequence selected from the group consisting of SEQ ID NOs:571-964. Each possibility represents a separate embodiment of the present invention.

According to yet additional aspect, the present invention provides a method for enhancing the resistance of a plant or a part thereof to at least one pathogenic fungus and/or Oomycete, comprising modulating the expression of at least one polynucleotide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polynucleotide having an nucleic acid sequence selected from the group consisting of SEQ ID NOs:55-527 within at least one cell of the plant or part thereof, thereby enhancing the resistance of said plant or part thereof to the at least one pathogenic fungus and/or Oomycetes compared to the resistance of a control plant. Each possibility represents a separate embodiment of the present invention.

According to certain embodiments, the polynucleotide is 80%-99% homologous to any one of the polynucleotides set forth in SEQ ID NOs:55-527. According to other embodiments, the polynucleotide is 85%-95% homologous to any one of the polynucleotides set forth in SEQ ID NOs:55-527. According to other embodiments, the polynucleotide is 90%-99% homologous to any one of the polynucleotides set forth in SEQ ID NOs:55-527.

According to certain embodiments, the polynucleotide comprises a nucleic acids sequence set forth in any one of SEQ ID NOs:55-564. According to other embodiments, the exogenous polynucleotide consists of a nucleic acids sequence set forth in any one of SEQ ID NOs:55-564. Each possibility represents a separate embodiment of the present invention.

According to another aspect, the present invention provides a method for producing a population of plants each having an enhanced resistance to at least one pathogenic fungus or Oomycete, comprising the steps of:

(a) modulating the expression and/or activity of at least one polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs:571-939 within at least one cell of each plant of the plant population as to produce a genetically engineered plant population;

(b) inoculating each plant of the genetically engineered plant population with the at least one pathogenic fungus; and (c) selecting plants showing an enhanced resistance to said at least one pathogenic fungus compared to a control or to a pre-determined resistance score value;

thereby producing a population of genetically engineered plants having enhanced resistance to said at least one pathogenic fungus.

According to certain embodiments, the method comprises modulating the expression and/or activity of a polypeptide having the amino acid sequence set forth in any one of SEQ ID NOs:571-977. According to other embodiments, the method comprise enhancing the expression and/or activity of a polypeptide having the amino acid sequence set forth in any one of SEQ ID NOs:965-977. According to yet additional embodiments, the method comprises enhancing the expression and/or activity of a polypeptide consisting of the amino acid sequence set forth in any one of SEQ ID NOs:571-977.

According to additional aspect, the present invention provides a method for selecting a plant having an enhanced resistance to at least one pathogenic fungus and/or Oomycete, comprising the steps of:

(a) providing a plurality of plants each comprising at least one cell with modulated expression and/or activity of a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs:571-939;

(b) inoculating the plurality of plants with the at least one pathogenic fungus or Oomycete; and (c) selecting plants showing an enhanced resistance to said at least one pathogenic fungus or Oomycete compared to a control plant or to a pre-determined resistance score value.

According to certain embodiments, the method comprises providing a plurality of plants each comprising at least one cell with modulated expression and/or activity of at least one polypeptide having the amino acid sequence set forth in any one of SEQ ID NOs:571-977. Each possibility represents a separate embodiment of the present invention. According to other embodiments, the method comprises providing a plurality of plants each having modulated expression and/or activity of at least one polypeptide having the amino acid sequence set forth in any one of SEQ ID NOs:965-977. Each possibility represents a separate embodiment of the present invention.

The plurality of plants having modulated expression and/or activity of the polypeptide may include plants having at least one cell with enhanced expression and/or activity of the polypeptide, plants having at least one cell with reduced expression and/or activity of the polypeptide or a combination thereof. Enhancing or reducing the expression and/or activity of the polypeptide can be performed as is known in the Art and as described hereinbelow.

Methods of enhancing the expression and/or activity of the polypeptide within the plant cell are known in the art.

According to another aspect, the present invention provides a method for conferring and/or enhancing the resistance of a grafted plant to at least one pathogenic fungus and/or Oomycete, the method comprising providing a scion and a rootstock, wherein the rootstock exhibits enhanced resistance to the at least one pathogenic fungus and/or Oomycete, said rootstock comprises at least one cell with a modulated expression of a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to the amino acid sequence selected from the group consisting of SEQ ID NOs:571-939 compared to the scion and grafting said scion onto said rootstock, thereby producing a grafted plant having an enhanced resistance to said at least one pathogenic fungus and/or Oomycete.

According to another aspect, the present invention provides a method for conferring and/or enhancing the resistance of a grafted plant to at least one pathogenic fungus and/or Oomycete, the method comprising providing a scion and a rootstock, the scion having an enhances resistance to the at least one pathogenic fungus and/or Oomycete, said scion comprises at least one cell with modulated expression of at least one polynucleotide encoding a polypeptide about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to the amino acid sequence selected from the group consisting of SEQ ID NOs:571-939 compared to the rootstock, and grafting said scion onto said rootstock, thereby producing a grafted plant having an enhanced resistance to the at least one pathogenic fungus and/or Oomycete.

According to certain embodiments, the polypeptide expressed in the scion or in the rootstock comprises an amino acid sequence selected from the group consisting of SEQ ID NOs:571-964.

According to certain embodiments, the scion or rootstock having enhanced resistance to the at least one fungus and/or Oomycete comprises at least one cell with enhanced expression and/or activity of the at least one polypeptide or the nucleotide encoding same. According to other embodiments, the scion or rootstock having enhanced resistance to the at least one fungus and/or Oomycete comprises at least one cell with reduced expression and/or activity of the at least one polypeptide or the nucleotide encoding same.

According to certain embodiments, the rootstock or the scion having enhanced resistance to the at least one fungus and/or Oomycete over-expresses a polynucleotide about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to a nucleic acid sequence set forth in any one of SEQ ID NOs: 57, 59-62, 69, 70, 73, 76-78, 84, 91, 93-95, 98, 113-116, 119, 123, 125-128, 135, 136, 138, 141-143, 149, 156, 158-160, 162, 177-180, and 183. According to some embodiments, the polynucleotide over-expressed in the rootstock or the scion comprises nucleic acid sequence selected from the group consisting of SEQ ID NOs:57, 59-62, 69, 70, 73, 76-78, 84, 91, 93-95, 98, 113-116, 119, 123, 125-128, 135, 136, 138, 141-143, 149, 156, 158-160, 162, 177-180, 183, 530, 531, 535, and 536.

According to some embodiments, the at least one polynucleotide is constitutively expressed in the transgenic rootstock. According to some embodiments, the at least one polynucleotide is expressed in the transgenic rootstock in a tissue specific or inducible manner According to some embodiments, the expression of the at least one polynucleotide is induced by biotic stress, particularly by fungi infection.

According to certain embodiments, the rootstock or the scion having enhanced resistance to the at least one fungus and/or Oomycete exhibit reduced expression of a polynucleotide about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to a nucleic acid sequence set forth in any one of SEQ ID NOs:74, 87, 103, 139, 152, and 167. According to some embodiments, the polynucleotide the expression of which is reduced in the rootstock or the scion comprises nucleic acid sequence selected from the group consisting of SEQ ID NOs: 74, 87, 103, 139, 152, and 167.

According to additional aspect, the present invention provides a method of growing a crop plant having enhanced resistance to at least one pathogenic fungus and/or Oomycete comprising the steps of:

(a) selecting a parent plant having a modulated expression of at least one polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to the amino acid sequence selected from the group consisting of SEQ ID NOs:5571-939, for enhanced resistance to at least one pathogenic fungus and/or Oomycete; and
(b) growing a progeny crop plant of the parent plant, wherein the progeny crop plant having modulated expression of the polynucleotide has an enhanced resistance to the at least one pathogenic fungus and/or Oomycete.

According to certain embodiments, the encoded polypeptide comprises the amino acid sequence set forth in any one of SEQ ID NOs:571-964. According to some embodiments, the encoded polypeptide consists of the amino acid sequence set forth in any one of SEQ ID NOs:571-964. Each possibility represents a separate embodiment of the present invention.

According to certain embodiments, the polynucleotide comprises a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a nucleic acid sequence set forth in any one of SEQ ID NOs:55-527. Each possibility represents a separate embodiment of the present invention.

According to certain embodiments, the polynucleotide comprises the nucleic acid sequence set forth in any one of SEQ ID NOs:55-564. According to some embodiments, the polynucleotide consists of the nucleic acid sequence set forth in any one of SEQ ID NOs:55-564. Each possibility represents a separate embodiment of the present invention.

According to certain embodiments, the modulated expression of the least one polynucleotide comprises up-regulation of said polynucleotide expression. According to certain embodiments, the modulated expression of the at least one polynucleotide comprises down-regulation of said polynucleotide expression.

According to yet additional aspect, the present invention provides a method of producing seeds of a crop comprising the steps of:

(a) selecting a parent plant having a modulated expression of at least one polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to the amino acid sequence selected from the group consisting of SEQ ID NOs:571-939 for enhanced resistance to at least one pathogenic fungus and/or Oomycete;
(b) growing the selected parent plant of step (a) to produce seeds;
(c) harvesting the produced seeds.

According to certain embodiments, the encoded polypeptide comprises the amino acid sequence set forth in any one of SEQ ID NOs:571-964. According to some embodiments, the encoded polypeptide consists of the amino acid sequence set forth in any one of SEQ ID NOs:571-964. Each possibility represents a separate embodiment of the present invention.

According to certain embodiments, the modulated expression of the least one polynucleotide comprises up-regulation of said polynucleotide expression. According to certain embodiments, the modulated expression of the least one polynucleotide comprises down-regulation of said polynucleotide expression.

According to some embodiments, the parent plant is transformed with at least one polynucleotide comprising the nucleic acid sequence set forth in any one of SEQ ID NOs:57, 59-62, 69, 70, 73, 76-78, 84, 91, 93-95, 98, 113-116, 119, 123, 125-128, 135, 136, 138, 141-143, 149, 156, 158-160, 162, 177-180, 183, 530, 531, 535, and 536. According to some embodiments, the polynucleotide consists of the nucleic acid sequence set forth in any one of SEQ ID NOs: 70, 136, 57, 59-62, 69, 73, 76-78, 84, 91, 93-95, 98, 113-116, 119, 123, 125-128, 135, 138, 141-143, 149, 156, 158-160, 162, 177-180, 183, 530, 531, 535, and 536.

According to certain embodiments, the seeds produced by the method of the invention comprise at least one cell having modulated expression of the polynucleotide. According to some embodiments, plants grown from the produced seed have enhanced resistance to at least one pathogenic fungus and/or Oomycete.

The present invention encompasses polynucleotides identified to be associated with resistance to at least one pathogenic fungus and/or Oomycete polypeptides encoded by same and homologs thereto.

According to certain embodiments, the exogenous polynucleotides employed in the methods of the present invention encode a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to an amino acid sequence set forth in any one of SEQ ID NOs:577-636, 940-942, and 966-977.

According to certain embodiments, the exogenous polynucleotides employed in the methods of the present invention comprise a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a nucleic acid sequence set forth in any one of SEQ ID NOs:55-120, 528-532, and 565.

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologs are evolutionary counterparts derived from a single ancestral gene in the last common ancestor of given two species (Koonin E V and Galperin M Y 2003. Sequence—Evolution—Function: Computational Approaches in Comparative Genomics. Boston: Kluwer Academic; Chapter 2, Evolutionary Concept in Genetics and Genomics) and therefore have great likelihood of having the same function.

One option to identify orthologues in monocot or in dicot plant species is by performing a reciprocal blast search. This may be done by a first blast involving blasting the sequence-of-interest against any sequence database, such as the publicly available NCBI database which may be found at: ncbi.nlm nih.gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An ortholog is identified when the sequence resulting in the highest score (best hit) in the first blast identifies in the second blast the query sequence (the original sequence-of-interest) as the best hit. Using the same rational a paralog (homolog to a gene in the same organism) is found. In case of large sequence families, the ClustalW program may be used (ebi.ac.uk/Tools/clustalw2/index.html), followed by a neighbor-joining tree (Wikipedia.org/wiki/Neighbor-joining) which helps visualizing the clustering.

Homology (e.g., percent homology, sequence identity+sequence similarity) can be determined using any homology comparison software computing a pairwise sequence alignment.

As used herein, "sequence identity" or "identity" in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. (Amino acid substitution matrices from protein blocks. Proc. Natl. Acad. Sci. U.S.A. 1992, 89(22): 10915-9).

Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., a homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 8%, 86%, 87%, 88%, 89%, 90%, 91%, 92%, 93%, 94%, 9%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from biocceleration(dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 8%, 88%, 89%, 90%, 91%, 9%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 8%, 88%, 89%, 90%, 91%, 9%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 8%, 88%, 89%, 90%, 91%, 9%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cutoff—60% Identity on a span of 60% of the sequences lengths because it is used only as a filter for the global alignment stage. In this specific embodiment (when the local identity is used), the default filtering of the Blast package is not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the Blastp Filter):

EMBOSS-6.0.1 Needleman-Wunsch algorithm with the following modified parameters: gapopen=8 gapextend=2. The rest of the parameters are unchanged from the default options listed here:

Standard (Mandatory) Qualifiers:

[-asequence] sequence Sequence filename and optional format, or reference (input USA)

[-bsequence] seqall Sequence(s) filename and optional format, or reference (input USA)

-gapopen float [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)

-gapextend float [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)

[-outfile] align [*.needle] Output alignment file name

Additional (Optional) Qualifiers:

-datafile matrixf [EBLOSUM62 for protein, EDNAFULL for DNA]. This is the scoring matrix file used when comparing sequences. By default it is the file 'EBLOSUM62' (for proteins) or the file 'EDNAFULL' (for nucleic sequences). These files are found in the 'data' directory of the EMBOSS installation.

Advanced (Unprompted) Qualifiers:

| | | |
|---|---|---|
| -[no]brief | boolean | [Y] Brief identity and similarity |

Associated Qualifiers:

| "-asequence" associated qualifiers | | |
|---|---|---|
| -sbegin1 | integer | Start of the sequence to be used |
| -send1 | integer | End of the sequence to be used |
| -sreverse1 | boolean | Reverse (if DNA) |
| -sask1 | boolean | Ask for begin/end/reverse |
| -snucleotide1 | boolean | Sequence is nucleotide |
| -sprotein1 | boolean | Sequence is protein |
| -slower1 | boolean | Make lower case |
| -supper1 | boolean | Make upper case |
| -sformat1 | string | Input sequence format |
| -sdbname1 | string | Database name |
| -sid1 | string | Entryname |
| -ufo1 | string | UFO features |
| -fformat1 | string | Features format |
| -fopenfile1 | string | Features file name |

| "-bsequence" associated qualifiers | | |
|---|---|---|
| -sbegin2 | integer | Start of each sequence to be used |
| -send2 | integer | End of each sequence to be used |
| -sreverse2 | boolean | Reverse (if DNA) |
| -sask2 | boolean | Ask for begin/end/reverse |
| -snucleotide2 | boolean | Sequence is nucleotide |
| -sprotein2 | boolean | Sequence is protein |
| -slower2 | boolean | Make lower case |
| -supper2 | boolean | Make upper case |
| -sformat2 | string | Input sequence format |
| -sdbname2 | string | Database name |
| -sid2 | string | Entryname |
| -ufo2 | string | UFO features |
| -fformat2 | string | Features format |
| -fopenfile2 | string | Features file name |

| "-outfile" associated qualifiers | | |
|---|---|---|
| -aformat3 | string | Alignment format |
| -aextension3 | string | File name extension |
| -adirectory3 | string | Output directory |
| -aname3 | string | Base file name |
| -awidth3 | integer | Alignment width |
| -aaccshow3 | boolean | Show accession number in the header |
| -adesshow3 | boolean | Show description in the header |
| -ausashow3 | boolean | Show the full USA in the alignment |
| -aglobal3 | boolean | Show the full sequence in alignment |

General Qualifiers:

| | | |
|---|---|---|
| -auto | boolean | Turn off prompts |
| -stdout | boolean | Write first file to standard output |
| -filter | boolean | Read first file from standard input, write first file to standard output |
| -options | boolean | Prompt for standard and additional values |
| -debug | boolean | Write debug output to program.dbg |
| -verbose | boolean | Report some/full command line options |
| -help | boolean | Report command line options. More information on associated and general qualifiers can be found with -help -verbose |
| -warning | boolean | Report warnings |
| -error | boolean | Report errors |
| -fatal | boolean | Report fatal errors |
| -die | boolean | Report dying program messages |

2. Between a Protein Sequence and a Nucleotide Sequence (Following the Tblastn Filter):

GenCore 6.0 OneModel application utilizing the Frame+ algorithm with the following parameters: model=frame+_p2n.model mode=qglobal -q=protein.sequence -db=nucleotide. sequence. The rest of the parameters are unchanged from the default options:

Usage:

om -model=<model_fname> [-q=]query [-db=]database [options]

-model=<model_fname> Specifies the model that you want to run. All models supplied by Compugen are located in the directory $CGNROOT/models/.

Valid Command Line Parameters:

-dev=<dev_name> Selects the device to be used by the application.

Valid devices are:

bic—Bioccelerator (valid for SW, XSW, FRAME_N2P, and FRAME_P2N models).

xlg—BioXL/G (valid for all models except XSW).

xlp—BioXL/P (valid for SW, FRAME+_N2P, and FRAME_P2N models).

xlh—BioXL/H (valid for SW, FRAME+_N2P, and FRAME_P2N models).

soft—Software device (for all models).

-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.

-db=<database name> Chooses the database set. The database set can be a sequence file or a database reference. The database format is detected automatically.

However, you may specify a format using -dfmt parameter.

-qacc Add this parameter to the command line if you specify query using accession numbers.

-dacc Add this parameter to the command line if you specify a database using accession numbers.

-dfmt/-qfmt=<format_type> Chooses the database/query format type. Possible formats are:

fasta—fasta with seq type auto-detected.
fastap—fasta protein seq.
fastan—fasta nucleic seq.
gcg—gcg format, type is auto-detected.
gcg9seq—gcg9 format, type is auto-detected.
gcg9seqp—gcg9 format protein seq.
gcg9seqn—gcg9 format nucleic seq.
nbrf—nbrf seq, type is auto-detected.
nbrfp—nbrf protein seq.
nbrfn—nbrf nucleic seq.
embl—embl and swissprot format.
genbank—genbank format (nucleic).
blast—blast format.
nbrf_gcg—nbrf-gcg seq, type is auto-detected.
nbrf_gcgp—nbrf-gcg protein seq.
nbrf_gcgn—nbrf-gcg nucleic seq.
raw—raw ascii sequence, type is auto-detected.
rawp—raw ascii protein sequence.
rawn—raw ascii nucleic sequence.
pir—pir codata format, type is auto-detected.
profile—gcg profile (valid only for -qfmt in SW, XSW, FRAME_P2N, and FRAME+_P2N).

-out=<out_fname> The name of the output file.

-suffix=<name> The output file name suffix.

-gapop=<n> Gap open penalty. This parameter is not valid for FRAME+. For FrameSearch the default is 12.0. For other searches the default is 10.0.

-gapext=<n> Gap extend penalty. This parameter is not valid for FRAME+. For FrameSearch the default is 4.0. For other models: the default for protein searches is 0.05, and the default for nucleic searches is 1.0.

-qgapop=<n> The penalty for opening a gap in the query sequence. The default is 10.0. Valid for XSW.

-qgapext=<n> The penalty for extending a gap in the query sequence. The default is 0.05. Valid for XSW.

-start=<n> The position in the query sequence to begin the search.

-end=<n> The position in the query sequence to stop the search.

-qtrans Performs a translated search, relevant for a nucleic query against a protein database. The nucleic query is translated to six reading frames and a result is given for each frame.

Valid for SW and XSW.

-dtrans Performs a translated search, relevant for a protein query against a DNA database. Each database entry is translated to six reading frames and a result is given for each frame.

Valid for SW and XSW.

Note: "-qtrans" and "-dtrans" options are mutually exclusive.

-matrix=<matrix_file> Specifies the comparison matrix to be used in the search.

The matrix must be in the BLAST format. If the matrix file is not located in $CGNROOT/tables/matrix, specify the full path as the value of the -matrix parameter.

-trans=<transtab_name> Translation table. The default location for the table is $CGNROOT/tables/trans.

-onestrand Restricts the search to just the top strand of the query/database nucleic sequence.

-list=<n> The maximum size of the output hit list. The default is 50.

-docalign=<n> The number of documentation lines preceding each alignment.

The default is 10.

-thr_score=<score_name> The score that places limits on the display of results. Scores that are smaller than -thr_min value or larger than -thr_max value are not shown. Valid options are: quality.

zscore.

escore.

-thr_max=<n> The score upper threshold. Results that are larger than -thr_max value are not shown.

-thr_min=<n> The score lower threshold. Results that are lower than -thr_min value are not shown.

-align=<n> The number of alignments reported in the output file.

-noalign Do not display alignment.

Note: "-align" and "-noalign" parameters are mutually exclusive.

-outfmt=<format_name> Specifies the output format type. The default format is PFS. Possible values are:

PFS—PFS text format

FASTA—FASTA text format

BLAST—BLAST text format

-nonorm Do not perform score normalization.

-norm=<norm_name> Specifies the normalization method. Valid options are:

log—logarithm normalization.

std—standard normalization.

stat—Pearson statistical method.

Note: "-nonorm" and "-norm" parameters cannot be used together.

Note: Parameters -xgapop, -xgapext, -fgapop, -fgapext, -ygapop, -ygapext, -delop, and -delext apply only to FRAME+.

-xgapop=<n> The penalty for opening a gap when inserting a codon (triplet).

The default is 12.0.

-xgapext=<n> The penalty for extending a gap when inserting a codon (triplet). The default is 4.0.

-ygapop=<n> The penalty for opening a gap when deleting an amino acid. The default is 12.0.

-ygapext=<n> The penalty for extending a gap when deleting an amino acid.

The default is 4.0.

-fgapop=<n> The penalty for opening a gap when inserting a DNA base. The default is 6.0.

-fgapext=<n> The penalty for extending a gap when inserting a DNA base. The default is 7.0.

-delop=<n> The penalty for opening a gap when deleting a DNA base. The default is 6.0.

-delext=<n> The penalty for extending a gap when deleting a DNA base. The default is 7.0.

-silent No screen output is produced.

-host=<host_name> The name of the host on which the server runs. By default, the application uses the host specified in the file $CGNROOT/cgnhosts.

-wait Do not go to the background when the device is busy. This option is not relevant for the Parseq or Soft pseudo device.

-batch Run the job in the background. When this option is specified, the file "$CGNROOT/defaults/batch.defaults" is used for choosing the batch command. If this file does not exist, the command "at now" is used to run the job.

Note: "-batch" and "-wait" parameters are mutually exclusive.

-version Prints the software version number.

-help Displays this help message. To get more specific help type:

"om -model=<model_fname>-help".

According to some embodiments the homology is a local homology or a local identity.

Local alignments tools include, but are not limited to the BlastP, BlastN, BlastX or TBLASTN software of the National Center of Biotechnology Information (NCBI), FASTA, and the Smith-Waterman algorithm.

A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.

Default parameters for blastp include: Max target sequences: 100; Expected threshold: e-5; Word size: 3; Max matches in a query range: 0; Scoring parameters: Matrix—BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

Modulating the expression and/or activity of the polypeptides of the present invention within a plant cell as to enhance the resistance of the plant to the pathogenic fungi and/or Oomycetes may include enhancing the expression and/or activity of polypeptides identified to positively contribute to the plant defense mechanism against the pathogenic fungi, or reducing the expression and/or activity of those polypeptides found to be associated with susceptibility to the fungus or Oomycete infection.

According to certain embodiments, enhancing the resistance of the plant or part thereof to the pathogenic fungus and/or Oomycete comprises enhancing the expression and/or activity of the at least one polypeptide compared to its expression and/or activity in the control plant.

According to certain aspects, the present invention provides a method for enhancing the resistance of a plant or a part thereof to at least one pathogenic fungus and/or Oomycete comprising expressing at least one exogenous polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs: 573, 575-578, 585, 586, 589, 592-594, 600, 607, 609-611, 614, 629-632, 635, 641, 642, 645, and 651-654 within at least one cell of the plant or part thereof, thereby enhancing the resistance of said plant or part thereof to the at least one pathogenic fungus and/or Oomycete compared to the resistance of a control plant. Each possibility represents a separate embodiment of the present invention. According to certain embodiments, the method comprises expression at least one exogenous polynucleotide encoding a polypeptide comprising the amino acid sequence set forth in any one of SEQ ID NOs: 573, 575-578, 585, 586, 589, 592-594, 600, 607, 609-611, 614, 629-632, 635, 641, 642, 645, 651-654, 942, and 943.

According to certain embodiments, enhancing the expression and/or activity of the polypeptide comprises introducing into at least one cell of the plant or part thereof an exogenous polynucleotide encoding said polypeptide, thereby producing a transgenic plant over-expressing said polypeptide compared to the control plant.

According to certain embodiments, the exogenous polynucleotide encodes a polypeptide endogenous to the at least one cell. According to other embodiments, the exogenous polynucleotide encodes a polypeptide heterologous to the at least one plant cell.

According to certain embodiments, the polynucleotide comprises a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a nucleic acid sequence selected from the group consisting of SEQ ID NOs: 57, 59-62, 69, 70, 73, 76-78, 84, 91, 93-95, 98, 113-116, 119, 123, 125-128, 135, 136, 138, 141-143, 149, 156, 158-160, 162, 177-180, and 183. Each possibility represents a separate embodiment of the present invention.

According to certain embodiments, the polynucleotide is 80%-99% homologous to any one of the polynucleotides set forth in SEQ ID NOs: 57, 59-62, 69, 70, 73, 76-78, 84, 91, 93-95, 98, 113-116, 119, 123, 125-128, 135, 136, 138, 141-143, 149, 156, 158-160, 162, 177-180, and 183. According to other embodiments, the polynucleotide is 85%-95% homologous to any one of the polynucleotides set forth in SEQ ID NOs: 57, 59-62, 69, 70, 73, 76-78, 84, 91, 93-95, 98, 113-116, 119, 123, 125-128, 135, 136, 138, 141-143, 149, 156, 158-160, 162, 177-180, and 183. According to other embodiments, the polynucleotide is 90%-99% homologous to any one of the polynucleotides set forth in SEQ ID NOs: 57, 59-62, 69, 70, 73, 76-78, 84, 91, 93-95, 98, 113-116, 119, 123, 125-128, 135, 136, 138, 141-143, 149, 156, 158-160, 162, 177-180, and 183

According to other embodiments, the polynucleotide comprises the nucleic acid sequence set for the one any one of SEQ ID NOs:57, 59-62, 69, 70, 73, 76-78, 84, 91, 93-95, 98, 113-116, 119, 123, 125-128, 135, 136, 138, 141-143, 149, 156, 158-160, 162, 177-180, 183, 530, 531, 535, and 536. Each possibility represents a separate embodiment of the present invention. According to additional embodiments, the polynucleotide consists of the nucleic acid sequence set for the one any one of SEQ ID NOs: 57, 59-62, 69, 70, 73, 76-78, 84, 91, 93-95, 98, 113-116, 119, 123, 125-128, 135, 136, 138, 141-143, 149, 156, 158-160, 162, 177-180, 183, 530, 531, 535, and 536. Each possibility represents a separate embodiment of the present invention.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest, and/or to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure. For example (see U.S. Pat. No. 7,214,862), the standard deviation of codon usage (SDCU), a measure of codon usage bias, may be calculated by first finding the squared proportional deviation of usage of each codon of the native gene relative to that of highly expressed plant genes, followed by a calculation of the average squared deviation. The formula used is:

$$\sum_{n=1}^{N}[(X_n - Y_n)/Y_n]2/N$$

wherein Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

Alternative method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (www kazusa.or.jp/codon/). The Codon Usage Database contains codon usage tables for a number of different species, with each codon usage Table having been statistically determined based on the data present in Genbank.

By using the tables described above to determine the most preferred or most favored codons for each amino acid in a particular species (for example, rice), a naturally-occurring nucleotide sequence encoding a protein of interest can be codon optimized for that particular plant species. This is affected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively affect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application Publication No. WO 93/07278.

According to additional aspect, the present invention provides an isolated polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to an amino acid sequence selected from the group consisting of SEQ ID NOs:571-939. According to certain embodiments, the present invention provides an isolated polynucleotide encoding a polypeptide comprising the amino acid sequence set forth in any one of SEQ ID NOs:571-964. According to additional embodiments, the present invention provides an isolated polypeptide consisting of the amino acid sequence set forth in any one of SEQ ID NOs:571-964. According to certain embodiments, the present invention provides an isolated polynucleotide encoding a polypeptide comprising the amino acid sequence set forth in any one of SEQ ID NOs:940-964. According to certain embodiments, the present invention provides an isolated polynucleotide encoding a polypeptide consisting of the amino acid sequence set forth in any one of SEQ ID NOs:940-964. Each possibility represents a separate embodiment of the present invention.

The invention also encompasses fragments of the above described polypeptides and polypeptides having mutations, such as deletions, insertions or substitutions of one or more amino acids, either naturally occurring or man induced, either randomly or in a targeted fashion.

According to additional aspect, the present invention provides an isolated polynucleotide, a fragment or a mutant thereof, the polynucleotide comprising a nucleic acids sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to a nucleic acid sequence selected from the group consisting of SEQ ID NOs:55-527. According to certain embodiments, the present invention provides an isolated polynucleotide, a fragment or a mutant thereof, the polynucleotide comprising the nucleic acid sequence set forth in any one of SEQ ID NOs:55-564. According to additional embodiments, the present invention provides an isolated polynucleotide, a fragment or a mutant thereof, the polynucleotide consisting of the nucleic acid sequence set forth in any one of SEQ ID NOs:55-564.

The isolated polynucleotides and polypeptides of the present invention and the fragment thereof are associated with conferring and/or increasing the resistance of a plant to at least one pathogenic fungus and/or Oomycete.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

According to additional aspect, the present invention provides a nucleic acid construct comprising the isolated polynucleotide of the invention, further comprising at least one regulatory element for directing transcription of the nucleic acid sequence in a host plant cell.

According to some embodiments of the invention, expressing the exogenous polynucleotide of the invention within a plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of some embodiments of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

According to some embodiments of the invention, the isolated polynucleotide is heterologous to the plant cell (e.g., the polynucleotide is derived from a different plant species when compared to the plant cell, thus the isolated polynucleotide and the plant cell are not from the same plant species).

Any suitable promoter sequence can be used by the nucleic acid construct of the present invention. Preferably the promoter is selected from the group consisting of a constitutive promoter, a tissue-specific, or biotic-stress specific promoter, particularly promoters inducible by fungi infection.

According to some embodiments of the invention, the promoter is a plant promoter, which is suitable for expression of the exogenous polynucleotide in a plant cell.

Suitable promoters for expression in wheat include, but are not limited to, Wheat SPA promoter (SEQ ID NO:1; Albanietal, 1997. Plant Cell, 9:171-184); wheat LMW [SEQ ID NO:2 (longer LMW promoter) and SEQ ID NO:3 (LMW promoter)]; HMW glutenin-1 [SEQ ID NO:4; (Wheat HMW glutenin-1 longer promoter); and SEQ ID NO:5 (Wheat HMW glutenin-1 Promoter); Thomas and Flavell, 1990. The Plant Cell 2:1171-1180; Furtado et al., 2009. Plant Biotechnology Journal 7:240-253]; wheat alpha, beta and gamma gliadins [e.g., SEQ ID NO:6 (wheat alpha gliadin, B genome, promoter); SEQ ID NO:7 (wheat gamma gliadin promoter); Rafalski J A et al. 1984. EMBO 3:1409-1415], wheat TdPR60 [SEQ ID NO:8 (wheat TdPR60 longer promoter) or SEQ ID NO:9 (wheat TdPR60 promoter); Kovalchuk et al., 2009. Plant Mol Biol 71:81-98], maize Ub1 Promoter [cultivar Nongda 105 (SEQ ID NO:10); GenBank: DQ141598.1; Taylor et al., 1993. Plant Cell Rep 12: 491-495; and cultivar B73 (SEQ ID NO:11; Christensen, A H et al. 1992. Plant Mol. Biol. 18(4):675-689); rice actin 1 (SEQ ID NO:12; Mc Elroy et al. 1990, The Plant Cell (2):163-171 rice GOS2 [SEQ ID NO:13 (rice GOS2 longer promoter) and SEQ ID NO:14 (rice GOS2 Promoter); De Pater et al. 1992. Plant J. 2: 837-44], *arabidopsis* Pho1 [SEQ ID NO:15 (*arabidopsis* Pho1 Promoter); Hamburger et al., Plant Cell. 2002; 14: 889-902,], ExpansinB promoters, e.g., rice ExpB5 [SEQ ID NO:16 (rice ExpB5 longer promoter) and SEQ ID NO:17 (rice ExpB5 promoter)] and Barley ExpB1 [SEQ ID NO:18 (barley ExpB1 Promoter); Won et al. Mol Cells. 2010. 30:369-76], barley SS2 (sucrose synthase 2; SEQ ID NO:19; Guerin and Carbonero, 1997. Plant Physiology 114(1):55-62), and rice PG5a (SEQ ID NO:20; U.S. Pat. No. 7,700,835; Nakase et al., 1996. Plant Mol Biol. 32:621-30).

Suitable constitutive promoters include, for example, CaMV 35S promoter [SEQ ID NO:21 (CaMV 35S (pQXNc) Promoter); SEQ ID NO:22 (PJJ 35S from *Brachypodium*); SEQ ID NO:23 (CaMV 35S (OLD) Promoter; Odell et al., Nature 313:810-812, 1985)], *Arabidopsis* At6669 promoter [SEQ ID NO:24 (*Arabidopsis* At6669 (OLD) Promoter; see PCT Publication No. WO04081173 or the new At6669 promoter (SEQ ID NO:25 (*Arabidopsis* At6669 (NEW) Promoter)]; maize Ub1 Promoter [cultivar Nongda 105 (SEQ ID NO:10); and cultivar B73 (SEQ ID NO:11)]; rice actin 1 (SEQ ID NO:12); pEMU (Last et al., 1991. Theor. Appl. Genet. 81:581-588); CaMV 19S (Nilsson et al., 1997. Physiol. Plant 100:456-462); rice GOS2 [SEQ ID NO:13 (rice GOS2 longer Promoter) and SEQ ID NO: 14 (rice GOS2 Promoter); RBCS promoter (SEQ ID NO:26); Rice cyclophilin (Bucholz et al., 1994 Plant Mol Biol. 25(5):837-43); Maize H3 histone (Lepetit et al., 1992 Mol. Gen. Genet. 231: 276-285); Actin 2 (An et al., 1996. Plant J. 10(1); 107-121) and Synthetic Super MAS (Ni et at, 1995. The Plant Journal 7: 661-676). Other constitutive promoters include those in U.S. Pat. Nos. 5,659,026; 5,608,149; 5,608,144; 5,604,121; 5,569,597; 5,466,785; 5,399,680; 5,268,463; and 5,608,142.

Suitable tissue-specific promoters include, but are not limited to, leaf-specific promoters [e.g., AT5G06690 (Thioredoxin), high expression, SEQ ID NO:27); AT5G61520 (AtSTP3, low expression, SEQ ID NO:28, described in Buttner et al., 2000. Plant, Cell and Environment 23:175-184); or the promoters described in Yamamoto et at, 1997. Plant J. 12:255-265; Kwon et al., 1994. Plant Physiol. 105:357-67; Yamamoto et al., 1994. Plant Cell Physiol. 35:773-778; Gotor et at, 1993. Plant J. 3:509-18; Orozco et al., Plant Mol. Biol. 1993. 23:1129-1138; and Matsuoka et al., 1993. Proc. Natl. Acad. Sci. USA 90:9586-9590; as well as *Arabidopsis* STP3 (AT5G61520) promoter (Buttner et al., 2000. Plant, Cell and Environment 23:175-184]; seed-preferred promoters [e.g., Napin (originated from *Brassica napus* which is characterized by a seed specific promoter activity; Stuitje A. R. et. al. 2003. Plant Biotechnology Journal 1(4):301-309; SEQ ID NO:29 (*Brassica napus* NAPIN Promoter) from seed specific genes (Simon, et al., 1985. Plant Mol. Biol. 5:191; Scofield, et at, 1987. J. Biol.

Chem. 262:12202; Baszczynski, et al., 1990. Plant Mol. Biol. 14:633), rice PG5a (SEQ ID NO:20; U.S. Pat. No. 7,700,835), early seed development *Arabidopsis* BAN (AT1G61720) (SEQ ID NO:30, US 2009/0031450), late seed development *Arabidopsis* ABI3 (AT3G24650) (SEQ ID NO:31 (*Arabidopsis* ABI3 (AT3G24650) longer Promoter) or SEQ ID NO:32 (*Arabidopsis* ABI3 (AT3G24650) Promoter)) (Ng et al., 2004. Plant Molecular Biology 54: 25-38), Brazil Nut albumin (Pearson' et at, 1992. Plant Mol. Biol. 18: 235-245), legumin (Ellis, et al. 1988. Plant Mol. Biol. 10: 203-214), Glutelin (rice) (Takaiwa et at, 1986. Mol. Gen. Genet. 208:15-22; Takaiwa et al., 1987. FIBS Letts. 221: 43-47), Zein (Matzke et al., 1990. Plant Mol Biol, (143):323-332), napA (Stalberg et al., 1996. Planta 199:515-519); Wheat SPA (SEQ ID NO:1); sunflower oleosin (Cummins et al., 1992. Plant Mol. Biol. 19: 873-876); endosperm specific promoters [e.g., wheat LMW (SEQ ID NO:2; Wheat LMW Longer Promoter), and SEQ ID NO:3 (Wheat LMW Promoter)] and HMW glutenin-1 [(SEQ ID NO:4 (Wheat HMW glutenin-1 longer Promoter); and SEQ ID NO:5 (Wheat HMW glutenin-1 Promoter); Colot et al., Mol Gen Genet 216:81-90, 1989; Olin et al., NAR 17:461-2, 1989), wheat alpha, beta and gamma gliadins (SEQ ID NO:6 (wheat alpha gliadin (B genome) promoter); SEQ ID NO:7 (wheat gamma gliadin promoter); Barley ltr1 promoter, barley B1, C, D hordein (Cho et al., Theor Appl Gen 98:1253-62, 1999; Muller et al., Plant J 4:343-55, 1993; Sorenson et al., Mol Gen Genet 250:750-60, 1996), Barley DOF (Mena et al., 1998. The Plant Journal 116(1):53-62), Biz2 (EP99106056.7), Barley SS2 (SEQ ID NO:19), wheat Tarp60 (Kovalchuk et al., 2009. Plant Mol Biol 71:81-98), barley D-hordein (D-Hor) and B-hordein (B-Hor) (Agnelo F et al., 2009. Plant Biotech J 793):240-253)], Synthetic promoter (Vicente-Carbajosa et at, 1998. Plant J. 13: 629-640), rice prolamin NRP33, rice -globulin Glb-1 (Wu et al., 1998. Plant Cell Physiology 39(8) 885-889), rice alpha-globulin REB/OHP-1 (Nakase et al. 1997. Plant Mol. Biol. 33: 513-S22), rice ADP-glucose PP (Russell et al., Trans Res 6:157-68, 1997), maize ESR gene family (Opsahl-Ferstad et al., Plant J 12:235-46, 1997), sorgum gamma-kafirin (DeRose et al., PMB 32:1029-35, 1996)], embryo specific promoters [e.g., rice OSH1 (Sato et al., Proc. Natl. Acad. Sci. USA, 93: 8117-8122, 1996), KNOX (Postma-Haarsma et al., 1999. Plant Mol. Biol. 39:257-71), rice oleosin (Wu et al., 1998. J. Biochem., 123:386], and flower-specific promoters [e.g., AtPRP4, chalene synthase (chsA) (Van der Meer et al., 1990. Plant Mol. Biol. 15, 95-109), LAT52 (Twell et al., 1989. Mol. Gen Genet 217:240-245), *Arabidopsis apetala*-3 (Tilly et al., 1998. Development 125:1647-57), *Arabidopsis* APETALA 1 (AT1G69120, AP1) (SEQ ID NO:33 (*Arabidopsis* (AT1G69120) APETALA 1)) (Hempel et at, 1997. Development 124:3845-3853)], and root promoters [e.g., the ROOTP promoter [SEQ ID NO:34]; rice ExpB5 [SEQ ID NO:17 (rice ExpB5 Promoter); or SEQ ID NO:16 (rice ExpB5 longer Promoter)] and barley ExpB1 promoters (SEQ ID NO:18) (Won et al. 2010. Mol. Cells 30: 369-376); *Arabidopsis* ATTPS-CIN (AT3G25820) promoter (SEQ ID NO:35; Chen et al., 2004. Plant Phys 135:1956-66); *Arabidopsis* Pho1 promoter (SEQ ID NO: 15), which is also slightly induced by stress].

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol. & Plant. Mol. Biol. 1991. 42:205-225; Shimamoto et al., 1989. Nature 338:274-276).

The principle methods of causing stable integration of exogenous DNA into plant genomic DNA include two main approaches:

(i) *Agrobacterium*-mediated gene transfer: Klee et al., (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell

Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plant is generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include, for example, Cauliflower mosaic virus (CaMV), Tobacco mosaic virus (TMV), brome mosaic virus (BMV) and Bean Common Mosaic Virus (BV or BCMV). Methods for transformation of plants using plant viruses are well known in the art; see, e.g. U.S. Pat. No. 4,855,237; Gluzman, Y. et at, Communications in Molecular Biology: Viral Vectors, Cold Spring Harbor Laboratory, New York, pp. 172-189 (1988); and Mortimer C et al., 2015. Current Opinion in Biotechnology 32:85-92). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-On et al., J Gener Viriol 73: 2183-87 (1992), Atreya et al. Viriology 191:106-11 (1992) and Huet et al. Viriology 75: 1407-14 (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology Vol 81 Humana Press, 1998). Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., 1989. Virology 172: 285-292; Takamatsu et al. 1987. EMBO J 6:307-311; French et al. 1986. Science 231:1294-1297; Takamatsu et al. 1990. FIBS Letters 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found, for example, in Foster and Taylor, Eds. "Plant Virology Protocols: From Virus Isolation to Transgenic Resistance (Methods in Molecular Biology (Humana Pr), Vol 81)", Humana Press, 1998; Maramorosh and Koprowski, Eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

According to some embodiments of the invention, the transformed plant is homozygote to the transgene (i.e., the exogenous polynucleotide of some embodiments of the invention), and accordingly all seeds generated thereby include the transgene.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, early flowering, grain filling period, harvest index, plant height, growth, biomass, yield and/or vigor traits, using conventional plant breeding techniques.

According to certain embodiments, enhancing the resistance of the plant or part thereof to the pathogenic fungus comprises reducing the expression and/or activity of the at least one polypeptide compared to its expression and/or activity in the control plant.

According to certain aspects, the present provides a method for enhancing the resistance of a plant or a part thereof to at least one pathogenic fungus and/or Oomycete comprising reducing the expression of at least one polynucleotide encoding a polypeptide having the amino acid sequence selected from the group consisting of SEQ ID NOs: 590, 603 and 619.

According to certain aspects, the present provides a method for enhancing the resistance of a plant or a part thereof to at least one pathogenic fungus and/or Oomycete comprising reducing the expression of at least one polynucleotide having the nucleic acid sequence selected from the group consisting of SEQ ID NOs:138, 152, and 167.

Any method as is known in the art for reducing the expression and/or activity of a plant endogenous protein and the polynucleotide encoding same can be used according to the teachings of the resent invention.

According to certain embodiment of the invention, reducing the expression and/or activity of a polypeptide of the invention within a plant cell comprising transforming the plant cell with a polynucleotide that inhibits the expression of said polypeptide. The polynucleotide may inhibit the transcription or translation of a polynucleotide encoding said polypeptide or can encode for an inhibitory polypeptide interfering with the translation or activity of said polypeptide.

Polynucleotide-Based Methods

According to some embodiments of the present disclosure, a plant is transformed with a polynucleotide that inhibits the expression of a polypeptide of the invention. According to certain exemplary embodiments, the plant cell is transformed within a construct capable of expressing the inhibitory polynucleotide. The term "expression" as used herein refers to the biosynthesis of a gene product, including the transcription and/or translation of said gene product. For example, for the purposes of the present invention, a construct capable of expressing the inhibitory polynucleotide is capable of producing an RNA molecule that inhibits the transcription and/or translation of a polypeptide of the invention. The "expression" or "production" of a protein or polypeptide from a DNA molecule refers to the transcription and translation of the coding sequence to produce the protein or polypeptide, while the "expression" or "production" of a protein or polypeptide from an RNA molecule refers to the translation of the RNA coding sequence to produce the protein or polypeptide. Examples of polynucleotides that inhibit the expression of a CCT polypeptide are given below.

Sense Suppression/Co-Suppression

According to certain embodiments, inhibition of the expression of a polypeptide of the invention may be obtained by sense suppression or co-suppression. For co-suppression, a construct is designed to express an RNA molecule corresponding to all or part of a messenger RNA encoding the polypeptide in the "sense" orientation. Over-expression of the RNA molecule can result in reduced expression of the native gene. Accordingly, multiple plant lines transformed with the co-suppression constructs are screened to identify those that show the greatest inhibition of the polypeptide expression.

The polynucleotide used for co-suppression may correspond to all or part of the sequence encoding the polypeptide of the invention, all or part of the 5' and/or 3' untranslated region of said polypeptide transcript or all or part of both the coding sequence and the untranslated regions of a transcript encoding said polypeptide. In some embodiments where the polynucleotide comprises all or part of the coding region for said polypeptide, the construct is designed to eliminate the start codon of the polynucleotide so that no protein product will be translated.

Co-suppression may be used to inhibit the expression of plant genes to produce plants having undetectable protein levels for the proteins encoded by these genes. See, for example, Broin, et al., (2002) Plant Cell 14:1417-1432. Co-suppression may also be used to inhibit the expression of multiple proteins in the same plant. See, for example, U.S. Pat. No. 5,942,657. Methods for using co-suppression to inhibit the expression of endogenous genes in plants are described, for example, in Yu, et al., Phytochemistry (2003) 63:753-763 and U.S. Pat. Nos. 5,034,323, 5,283,184 and 5,942,657. The efficiency of co-suppression may be increased by including a poly-dT region in the expression cassette at a position 3' to the sense sequence and 5' of the polyadenylation signal. See for example, US Patent Application Publication Number 2002/0048814. Typically, such a nucleotide sequence has substantial sequence identity to the sequence of the transcript of the endogenous gene, optimally greater than about 65% sequence identity, more optimally greater than about 85% sequence identity, most optimally greater than about 95% sequence identity (U.S. Pat. Nos. 5,283,184 and 5,034,323).

Antisense Suppression

According to some embodiments, inhibition of the expression of a polypeptide of the invention may be obtained by antisense suppression. For antisense suppression, the construct is designed to express an RNA molecule complementary to all or part of a messenger RNA encoding the polypeptide. Over-expression of the antisense RNA molecule can result in reduced expression of the native gene. Accordingly, multiple plant lines transformed with the antisense RNA are screened to identify those that show the greatest inhibition of said polypeptide expression.

The polynucleotide for use in antisense suppression may correspond to all or part of the complement of the sequence encoding the polypeptide of the invention, all or part of the complement of the 5' and/or 3' untranslated region of its transcript or all or part of the complement of both the coding sequence and the untranslated regions of a transcript encoding said polypeptide. In addition, the antisense polynucleotide may be fully complementary (i.e., 100% identical to the complement of the target sequence) or partially complementary (i.e., less than 100% identical to the complement of the target sequence) to the target sequence. Antisense suppression may be used to inhibit the expression of multiple proteins in the same plant. See, for example, U.S. Pat. No. 5,942,657. Furthermore, portions of the antisense nucleotides may be used to disrupt the expression of the target gene. Generally, sequences of at least 50 nucleotides, 100 nucleotides, 200 nucleotides, 300, 400, 450, 500, 550 or greater may be used. Methods for using antisense suppression to inhibit the expression of endogenous genes in plants are described, for example, in Liu, et al., (2002) Plant Physiol. 129:1732-1743 and U.S. Pat. Nos. 5,759,829 and 5,942,657. Efficiency of antisense suppression may be increased by including a poly-dT region in the expression cassette at a position 3' to the antisense sequence and 5' of the polyadenylation signal (see, e.g. US Patent Application Publication Number 2002/0048814).

Double-Stranded RNA Interference

According to some embodiments, inhibition of the expression of a polypeptide of the invention may be obtained by double-stranded RNA (dsRNA) interference. For dsRNA interference, a sense RNA molecule like that described above for co-suppression and an antisense RNA molecule that is fully or partially complementary to the sense RNA molecule are expressed in the same cell, resulting in inhibition of the expression of the corresponding endogenous messenger RNA.

Expression of the sense and antisense molecules can be accomplished by designing the DNA construct to comprise both a sense sequence and an antisense sequence. Alternatively, separate constructs may be used for the sense and antisense sequences. Multiple plant lines transformed with the dsRNA interference construct(s) are then screened to identify plant lines that show the greatest inhibition of the expression of the polypeptide. Methods for using dsRNA interference to inhibit the expression of endogenous plant genes are described in Waterhouse, et al., (1998) Proc. Natl. Acad. Sci. USA 95:13959-13964, Liu, et al., (2002) Plant Physiol. 129:1732-1743 and WO 1999/49029, WO 1999/53050, WO 1999/61631 and WO 2000/49035.

Hairpin RNA Interference and Intron-Containing Hairpin RNA Interference

According to some embodiments, inhibition of the expression of a polypeptide of the invention may be obtained by hairpin RNA (hpRNA) interference or intron-containing hairpin RNA (ihpRNA) interference. These methods are highly efficient at inhibiting the expression of endogenous genes. See, Waterhouse and Helliwell, (2003) Nat. Rev. Genet. 4:29-38 and the references cited therein.

For hpRNA interference, the construct is designed to express an RNA molecule that hybridizes with itself to form a hairpin structure that comprises a single-stranded loop region and a base-paired stem. The base-paired stem region comprises a sense sequence corresponding to all or part of the endogenous messenger RNA encoding the gene whose expression is to be inhibited and an antisense sequence that is fully or partially complementary to the sense sequence. Thus, the base-paired stem region of the molecule generally determines the specificity of the RNA interference. hpRNA molecules are highly efficient at inhibiting the expression of endogenous genes, and the RNA interference they induce is inherited by subsequent generations of plants. See, for example, Chuang and Meyerowitz, (2000) Proc. Natl. Acad. Sci. USA 97:4985-4990; Stoutjesdijk, et al., (2002) Plant Physiol. 129:1723-1731 and Waterhouse and Helliwell, (2003) Nat. Rev. Genet. 4:29-38. Methods for using hpRNA interference to inhibit or silence the expression of genes are described, for example, in US Patent Application Publication Number 2003/0175965. A transient assay for the efficiency of hpRNA constructs to silence gene expression in vivo has been described by Panstruga, et al., (2003) Mol. Biol. Rep. 30:135-140.

For Intron-Containing Hairpin RNA (ihpRNA) interference, the interfering molecules have the same general structure as for hpRNA, but the RNA molecule additionally comprises an intron that is capable of being spliced in the cell in which the ihpRNA is expressed. The use of an intron minimizes the size of the loop in the hairpin RNA molecule following splicing, and this increases the efficiency of interference. See, for example, Smith, et al., (2000) Nature 407:319-320. In fact, Smith, et al., shows 100% suppression of endogenous gene expression using ihpRNA-mediated interference. Methods for using ihpRNA interference to inhibit the expression of endogenous plant genes are described, for example, in US Patent Application Publication Number 2003/0180945.

The expression cassette for hpRNA interference may also be designed such that the sense sequence and the antisense sequence do not correspond to an endogenous RNA. In this embodiment, the sense and antisense sequence flank a loop sequence that comprises a nucleotide sequence corresponding to all or part of the endogenous messenger RNA of the target gene. Thus, it is the loop region that determines the specificity of the RNA interference. See, for example, WO 2002/00904.

Amplicon-Mediated Interference

Amplicon expression cassettes comprise a plant virus-derived sequence that contains all or part of the target gene but generally not all of the genes of the native virus. The viral sequences present in the transcription product of the construct allow the transcription product to direct its own replication. The transcripts produced by the amplicon may be either sense or antisense relative to the target sequence (i.e., the messenger RNA for the polypeptide of the invention). Methods of using amplicons to inhibit the expression of endogenous plant genes are described, for example, in Angell and Baulcombe, (1997) EMBO J. 16:3675-3684, Angell and Baulcombe, (1999) Plant J. 20:357-362.

Ribozymes

According to some embodiments, the polynucleotide expressed by the construct of the invention is catalytic RNA or has ribozyme activity specific for the messenger RNA of a polypeptide of the invention. Thus, the polynucleotide causes the degradation of the endogenous messenger RNA, resulting in reduced expression of said polypeptide. This method is described, for example, in U.S. Pat. No. 4,987,071.

Small Interfering RNA or Micro RNA

According to certain embodiments of the invention, inhibition of the expression of a polypeptide of the invention may be obtained by RNA interference by expression of a gene encoding a micro RNA (miRNA). miRNAs are regulatory agents consisting of about 22 ribonucleotides. miRNA are highly efficient at inhibiting the expression of endogenous genes. See, for example, Palatnikl J F et al., (2003) Nature 425:257-263.

For miRNA interference, the construct is designed to express an RNA molecule that is modeled on an endogenous miRNA gene. The miRNA gene encodes an RNA that forms a hairpin structure containing a 22-nucleotide sequence that is complementary to another endogenous gene (target sequence). For suppressing the expression of a polypeptide of the invention, the 22-nucleotide sequence is selected from the polypeptide transcript sequence and contains 22 nucleotides of said transcript sequence in sense orientation and 21 nucleotides of a corresponding antisense sequence that is complementary to the sense sequence. miRNA molecules are highly efficient at inhibiting the expression of endogenous genes and the RNA interference they induce is inherited by subsequent generations of plants.

Polypeptide-Based Inhibition of Gene Expression

According to certain additional or alternative embodiments, the inhibitory polynucleotide encodes a zinc finger protein that binds to a gene encoding a polypeptide of the invention, resulting in reduced expression of the gene. In particular embodiments, the zinc finger protein binds to a regulatory region of a polypeptide encoding gene. In other embodiments, the zinc finger protein binds to a messenger RNA encoding said polypeptide and prevents its translation. Methods of selecting sites for targeting by zinc finger proteins have been described, for example, in U.S. Pat. No. 6,453,242 and methods for using zinc finger proteins to inhibit the expression of genes in plants are described, for example, in U.S. Pat. No. 7,151,201.

Polypeptide-Based Inhibition of Protein Activity

According to certain additional or alternative embodiments, the polynucleotide encodes an antibody that binds to a polypeptide of the invention and reduces the activity of the polypeptide. In another embodiment, the binding of the antibody results in increased turnover of the antibody-polypeptide complex by cellular quality control mechanisms. The expression of antibodies in plant cells and the inhibition of molecular pathways by expression and binding of antibodies to proteins in plant cells are well known in the art. See, for example, Conrad and Sonnewald, (2003) Nature Biotech. 21:35-36.

According to some embodiments of the invention, up-regulation or down regulation of the expression and/or activity of the polypeptide of the invention is achieved by means of genome editing.

Genome editing is a reverse genetics method which uses artificially engineered nucleases to cut and create specific double-stranded breaks at a desired location(s) in the genome, which are then repaired by cellular endogenous processes such as, homology directed repair (HDR) and non-homologous end-joining (NHEJ). NHEJ directly joins the DNA ends in a double-stranded break, while HDR utilizes a homologous sequence as a template for regenerating the missing DNA sequence at the break point. In order to introduce specific nucleotide modifications to the genomic DNA, a DNA repair template containing the desired sequence must be present during HDR. Genome editing cannot be performed using traditional restriction endonucleases since most restriction enzymes recognize a few base pairs on the DNA as their target and the probability is very high that the recognized base pair combination will be found in many locations across the genome resulting in multiple cuts not limited to a desired location. To overcome this challenge and create site-specific single- or double-stranded breaks, several distinct classes of nucleases have been discovered and bioengineered to date. These include the meganucleases, Zinc finger nucleases (ZFNs), transcription-activator like effector nucleases (TALENs) and CRISPR/Cas system.

Genome editing is a powerful tool to impact target traits by modifications of the target plant genome sequence. Such modifications can result in new or modified alleles or regulatory elements.

In addition, the traces of genome-edited techniques can be used for marker assisted selection (MAS) as is further described hereinunder. Target plants for the mutagenesis/genome editing methods according to the invention are any plants of interest including monocot or dicot plants.

Over-expression of a polypeptide by genome editing can be achieved by: (i) replacing an endogenous sequence encoding the polypeptide of interest or a regulatory sequence under which it is placed, and/or (ii) inserting a new gene encoding the polypeptide of interest in a targeted region of the genome, and/or (iii) introducing point mutations which result in up-regulation of the gene encoding the polypeptide of interest (e.g., by altering the regulatory sequences such as promoter, enhancers, 5'-UTR and/or 3'-UTR, or mutations in the coding sequence).

Down regulation of the expression of a polypeptide by gnome editing can be achieved by (i) replacing an endogenous sequence encoding a polypeptide negatively affecting a desired plant trait, according to some embodiments of the invention enhancing susceptibility of the plant to pathogenic fungi and/or Oomycete or replacing a regulatory sequence under which the endogenous sequence encoding the polypeptide is placed, and/or (ii) introducing point mutations which result in down-regulation of the gene encoding the polypeptide of interest (e.g., by altering the regulatory sequences such as promoter, enhancers, 5'-UTR and/or 3'-UTR, or mutations in the coding sequence).

Genome Editing Systems Overview

Several systems have been reported to enable genome editing implementation. Examples detailed herein below:

Meganucleases—

Meganucleases are commonly grouped into four families: the LAGLIDADG family, the GIY-YIG family, the His-Cys box family and the HNH family. These families are characterized by structural motifs, which affect catalytic activity and recognition sequence. For instance, members of the LAGLIDADG family are characterized by having either one or two copies of the conserved LAGLIDADG motif. The four families of meganucleases are widely separated from one another with respect to conserved structural elements and, consequently, DNA recognition sequence specificity and catalytic activity. Meganucleases are found commonly in microbial species and have the unique property of having very long recognition sequences (>14 bp) thus making them naturally very specific for cutting at a desired location. This can be exploited to make site-specific double-stranded breaks directing modifications in regulatory elements or coding regions upon introduction of the desired sequence. One of skill in the art can use these naturally occurring meganucleases, however the number of such naturally occurring meganucleases is limited. To overcome this challenge, mutagenesis and high throughput screening methods have been used to create meganuclease variants that recognize unique sequences. For example, various meganucleases have been fused to create hybrid enzymes that recognize a new sequence. Alternatively, DNA interacting amino acids of the meganuclease can be altered to design sequence specific meganucleases (see e.g., U.S. Pat. No. 8,021,867). Meganucleases can be designed using the methods described in e.g., Certo, M T et al., 2012. Nature Methods 9:073-975; U.S. Pat. Nos. 8,304,222; 8,021,867; 8,119,381; 8,124,369; 8,129,134; 8,133,697; 8,143,015; 8,143,016; 8,148,098; or 8,163,514. Alternatively, meganucleases with site specific cutting characteristics can be obtained using commercially available technologies e.g., Precision Biosciences' Directed Nuclease Editor™ genome editing technology.

ZFNs and TALENs—

Two distinct classes of engineered nucleases, zinc-finger nucleases (ZFNs) and transcription activator-like effector nucleases (TALENs), have both proven to be effective at producing targeted double-stranded breaks (Christian et al., 2010. Genetics 186:757-761; Kim et al., 1996. Proc. Natl. Acad. Sci. 93:1156-1160; Li et al., 2011. Nucleic Acids Res 39:359-372; Mahfouz et al., 2011. Proc. Natl. Acad. Sci; 108:2623-2628; Miller et al., 2010. Nat Biotechnol. 29:143-148).

Basically, ZFNs and TALENs restriction endonuclease technology utilizes a non-specific DNA cutting enzyme which is linked to a specific DNA binding domain (either a series of zinc finger domains or TALE repeats, respectively). Typically a restriction enzyme whose DNA recognition site and cleaving site are separate from each other is selected. The cleaving portion is separated and then linked to a DNA binding domain, thereby yielding an endonuclease with very high specificity for a desired sequence. An exemplary restriction enzyme with such properties is Fold. Additionally Fold has the advantage of requiring dimerization to have nuclease activity and this means the specificity increases dramatically as each nuclease partner recognizes a unique DNA sequence. To enhance this effect, Fokl nucleases have been engineered that can only function as heterodimers and have increased catalytic activity. The heterodimer functioning nucleases avoid the possibility of unwanted homodimer activity and thus increase specificity of the double-stranded break.

Thus, for example to target a specific site, ZFNs and TALENs are constructed as nuclease pairs, with each member of the pair designed to bind adjacent sequences at the targeted site. Upon transient expression in cells, the nucleases bind to their target sites and the Fold domains heterodimerize to create a double-stranded break. Repair of these double-stranded breaks through the nonhomologous end-joining (NHEJ) pathway most often results in small deletions or small sequence insertions. Since each repair made by NHEJ is unique, the use of a single nuclease pair can produce an allelic series with a range of different deletions at the target site. The deletions typically range anywhere from a few base pairs to a few hundred base pairs in length, but larger deletions have successfully been generated in cell culture by using two pairs of nucleases simultaneously (Carlson et al., 2012. Proc. Natl. Acad. Sci 109:17382-17387; Lee et al., 2010. Genome Res 20:81-89). In addition, when a fragment of DNA with homology to the targeted region is introduced in conjunction with the nuclease pair, the double-stranded break can be repaired via homology directed repair to generate specific modifications (Li et al., 2011, ibid; Miller et al., 2010, ibid; Urnov et at, 2005. Nature, 435:646-651).

Although the nuclease portions of both ZFNs and TALENs have similar properties, the difference between these engineered nucleases is in their DNA recognition peptide. ZFNs rely on Cys2-His2 zinc fingers and TALENs on TALEs Both of these DNA recognizing peptide domains have the characteristic that they are naturally found in combinations in their proteins. Cys2-His2 Zinc fingers typically found in repeats that are 3 bp apart and are found in diverse combinations in a variety of nucleic acid interacting proteins. TALEs on the other hand are found in repeats with a one-to-one recognition ratio between the amino acids and the recognized nucleotide pairs. Because both zinc fingers and TALEs happen in repeated patterns, different combinations can be tried to create a wide variety of sequence specificities. Approaches for making site-specific zinc finger endonucleases include, e.g., modular assembly (where Zinc fingers correlated with a triplet sequence are attached in a row to cover the required sequence), OPEN (low-stringency selection of peptide domains vs. triplet nucleotides followed by high-stringency selections of peptide combination vs. the final target in bacterial systems), and bacterial one-hybrid screening of zinc finger libraries, among others. ZFNs can also be designed and obtained commercially from e.g., Sangamo Biosciences™ (Richmond, Calif.).

Method for designing and obtaining TALENs are described in e.g. Reyon et al., 2012. Nature Biotechnology 30(5):460-5; Miller et al., 2011. Nat Biotechnol. 29:143-148; Cermak et al., 2011. Nucleic Acids Research 39 (12): e82 and Zhang et al., 2011 Nature Biotechnology 29 (2): 149-53. A recently developed web-based program named Mojo Hand was introduced by Mayo Clinic for designing TAL and TALEN constructs for genome editing applications (can be accessed through www(dot)talendesign(dot)org). TALEN can also be designed and obtained commercially from e.g., Sangamo Biosciences™ (Richmond, Calif.).

The ZFN/TALEN system capability for precise targeting can be utilized for directing modifications in regulatory elements and/or coding regions upon introduction of the sequence of interest for trait improvement.

CRISPR/Cas9—

The CRISPR/Cas system for genome editing contains two distinct components: a gRNA (guide RNA) and an endonuclease e.g. Cas9.

The gRNA is typically a 20 nucleotide sequence encoding a combination of the target homologous sequence (crRNA) and the endogenous bacterial RNA that links the crRNA to the Cas9 nuclease (tracrRNA) in a single chimeric transcript. The gRNA/Cas9 complex is recruited to the target sequence by the base-pairing between the gRNA sequence and the complement genomic DNA. For successful binding of Cas9, the genomic target sequence must also contain the correct Protospacer Adjacent Motif (PAM) sequence immediately following the target sequence. The binding of the gRNA/Cas9 complex localizes the Cas9 to the genomic target sequence so that the Cas9 can cut both strands of the DNA causing a double-strand break. Just as with ZFNs and TALENs, the double-stranded brakes produced by CRISPR/Cas can undergo homologous recombination or NHEJ.

The Cas9 nuclease has two functional domains: RuvC and HNH, each cutting a different DNA strand. When both of these domains are active, the Cas9 causes double strand breaks in the genomic DNA.

A significant advantage of CRISPR/Cas is that the high efficiency of this system coupled with the ability to easily create synthetic gRNAs enables multiple genes to be targeted simultaneously. In addition, the majority of cells carrying the mutation present biallelic mutations in the targeted genes.

However, apparent flexibility in the base-pairing interactions between the gRNA sequence and the genomic DNA target sequence allows imperfect matches to the target sequence to be cut by Cas9.

Modified versions of the Cas9 enzyme containing a single inactive catalytic domain, either RuvC- or HNH-, are called 'nickases'. With only one active nuclease domain, the Cas9 nickase cuts only one strand of the target DNA, creating a single-strand break or 'nick'. A single-strand break, or nick, is normally quickly repaired through the HDR pathway, using the intact complementary DNA strand as the template. However, two proximal, opposite strand nicks introduced by a Cas9 nickase are treated as a double-strand break, in what is often referred to as a 'double nick' CRISPR system. A double-nick can be repaired by either NHEJ or HDR depending on the desired effect on the gene target. Thus, if specificity and reduced off-target effects are crucial, using the Cas9 nickase to create a double-nick by designing two gRNAs with target sequences in close proximity and on opposite strands of the genomic DNA would decrease off-target effect as either gRNA alone will result in nicks that will not change the genomic DNA.

Modified versions of the Cas9 enzyme containing two inactive catalytic domains (dead Cas9, or dCas9) have no nuclease activity while still able to bind to DNA based on gRNA specificity. The dCas9 can be utilized as a platform for DNA transcriptional regulators to activate or repress gene expression by fusing the inactive enzyme to known regulatory domains. For example, the binding of dCas9 alone to a target sequence in genomic DNA can interfere with gene transcription.

There is a number of publically available tools available to help choose and/or design target sequences as well as lists of bioinformatically determined unique gRNAs for different genes in different species such as the Feng Zhang lab's Target Finder, the Michael Boutros lab's Target Finder (E-CRISP), the RGEN Tools: Cas-OFFinder, the CasFinder: Flexible algorithm for identifying specific Cas9 targets in genomes and the CRISPR Optimal Target Finder.

In order to use the CRISPR system, both gRNA and Cas9 should be expressed in a target cell. The insertion vector can contain both cassettes on a single plasmid or the cassettes are expressed from two separate plasmids. CRISPR plasmids are commercially available such as the px330 plasmid from Addgene.

Recombinant Adeno-Associated Virus (rAAV) Platform— this genome-editing platform is based on rAAV vectors which enable insertion, deletion or substitution of DNA sequences in the genomes of live mammalian cells. The rAAV genome is a single-stranded deoxyribonucleic acid (ssDNA) molecule, either positive- or negative-sensed, which is about 4.7 kb long. These single-stranded DNA viral vectors have high transduction rates and have a unique property of stimulating endogenous homologous recombination in the absence of double-strand DNA breaks in the genome. One of skill in the art can design a rAAV vector to target a desired genomic locus and perform both gross and/or subtle endogenous gene alterations in a cell. rAAV genome editing has the advantage in that it targets a single allele and does not result in any off-target genomic alterations. rAAV genome editing technology is commercially available, for example, the rAAV GENESIS™ system from Horizon™ (Cambridge, UK).

Methods for qualifying efficacy and detecting sequence alteration are well known in the art and include, but not limited to, DNA sequencing, electrophoresis, an enzyme-based mismatch detection assay and a hybridization assay such as PCR, RT-PCR, RNase protection, in-situ hybridization, primer extension, Southern blot, Northern Blot and dot blot analysis. Sequence alterations in a specific gene can also be determined at the protein level using e.g. chromatography, electrophoretic methods, immunodetection assays such as ELISA and Western blot analysis and immunohistochemistry.

In addition, one ordinarily skilled in the art can readily design a knock-in/knock-out construct including positive and/or negative selection markers for efficiently selecting transformed cells that underwent a homologous recombination event with the construct. Positive selection provides a means to enrich the population of clones that have taken up foreign DNA. Non-limiting examples of such positive markers include glutamine synthetase, dihydrofolate reductase (DHFR), markers that confer antibiotic resistance, such as neomycin, hygromycin, puromycin, and blasticidin S resistance cassettes. Negative selection markers are necessary to select against random integrations and/or elimination of a marker sequence (e.g. positive marker). Non-limiting examples of such negative markers include the herpes simplex-thymidine kinase (HSV-TK) which converts ganciclovir (GCV) into a cytotoxic nucleoside analog, hypoxanthine phosphoribosyltransferase (HPRT) and adenine phosphoribosytransferase (ARPT).

Recombination Procedures—Common to Different Genome Editing Systems

Hit and run" or "in-out"—involves a two-step recombination procedure. In the first step, an insertion-type vector containing a dual positive/negative selectable marker cassette is used to introduce the desired sequence alteration. The insertion vector contains a single continuous region of homology to the targeted locus and is modified to carry the mutation of interest. This targeting construct is linearized with a restriction enzyme at a one site within the region of homology, electroporated into the cells, and positive selection is performed to isolate homologous recombinants. These homologous recombinants contain a local duplication that is separated by intervening vector sequence, including the selection cassette. In the second step, targeted clones are subjected to negative selection to identify cells that have lost the selection cassette via intrachromosomal recombination between the duplicated sequences. The local recombination event removes the duplication and, depending on the site of recombination, the allele either retains the introduced mutation or reverts to wild type. The end result is the introduction of the desired modification without the retention of any exogenous sequences.

The "double-replacement" or "tag and exchange" strategy—involves a two-step selection procedure similar to the hit and run approach, but requires the use of two different targeting constructs. In the first step, a standard targeting vector with 3' and 5' homology arms is used to insert a dual positive/negative selectable cassette near the location where the mutation is to be introduced. After electroporation and positive selection, homologously targeted clones are identified. Next, a second targeting vector that contains a region of homology with the desired mutation is electroporated into targeted clones, and negative selection is applied to remove the selection cassette and introduce the mutation. The final allele contains the desired mutation while eliminating unwanted exogenous sequences.

Site-Specific Recombinases—

The Cre recombinase derived from the P1 bacteriophage and Flp recombinase derived from the yeast *Saccharomyces cerevisiae* are site-specific DNA recombinases each recognizing a unique 34 base pair DNA sequence (termed "Lox" and "FRT", respectively) and sequences that are flanked with either Lox sites or FRT sites can be readily removed via site-specific recombination upon expression of Cre or Flp recombinase, respectively. For example, the Lox sequence is composed of an asymmetric eight base pair spacer region flanked by 13 base pair inverted repeats. Cre recombines the 34 base pair lox DNA sequence by binding to the 13 base pair inverted repeats and catalyzing strand cleavage and religation within the spacer region. The staggered DNA cuts made by Cre in the spacer region are separated by 6 base pairs to give an overlap region that acts as a homology sensor to ensure that only recombination sites having the same overlap region recombine. Basically, the site specific recombinase system offers means for the removal of selection cassettes after homologous recombination. This system also allows for the generation of conditional altered alleles that can be inactivated or activated in a temporal or tissue-specific manner. Of note, the Cre and Flp recombinases leave behind a Lox or FRT "scar" of 34 base pairs. The Lox or FRT sites that remain are typically left behind in an intron or 3' UTR of the modified locus, and current evidence suggests that these sites usually do not interfere significantly with gene function. Thus, Cre/Lox and Flp/FRT recombination involves introduction of a targeting vector with 3' and 5' homology arms containing the mutation of interest, two Lox or FRT sequences and typically a selectable cassette placed between the two Lox or FRT sequences. Positive selection is applied and homologous recombinants that contain targeted mutation are identified. Transient expression of Cre or Flp in conjunction with negative selection results in the excision of the selection cassette and selects for cells where the cassette has been lost. The final targeted allele contains the Lox or FRT scar of exogenous sequences.

Transposases—

As used herein, the term "transposase" refers to an enzyme that binds to the ends of a transposon and catalyzes the movement of the transposon to another part of the genome.

As used herein the term "transposon" refers to a mobile genetic element comprising a nucleotide sequence which can move around to different positions within the genome of a single cell. In the process the transposon can cause mutations and/or change the amount of a DNA in the genome of the cell. A number of transposon systems that are able to also transpose in cells e.g. vertebrates have been isolated or designed, such as Sleeping Beauty [Izsvak and Ivics Molecular Therapy (2004) 9: 147-156], piggyBac [Wilson et al. Molecular Therapy (2007) 15: 139-145], Tol2 [Kawakami et al. PNAS (2000) 97 (21): 11403-11408] or Frog Prince [Miskey et al. Nucleic Acids Res. Dec. 1, (2003) 31(23): 6873-6881]. Generally, DNA transposons translocate from one DNA site to another in a simple, cut-and-paste manner Each of these elements has their own advantages, for example, Sleeping Beauty is particularly useful in region-specific mutagenesis, whereas Tol2 has the highest tendency to integrate into expressed genes. Hyperactive systems are available for Sleeping Beauty and piggyBac. Most importantly, these transposons have distinct target site preferences, and can therefore introduce sequence alterations in overlapping, but distinct sets of genes. Therefore, to achieve the best possible coverage of genes, the use of more than one element is particularly preferred. The basic mechanism is shared between the different transposases, therefore the piggyBac (PB) is described as an example. PB is a 2.5 kb insect transposon originally isolated from the cabbage looper moth, *Trichoplusia ni*. The PB transposon consists of asymmetric terminal repeat sequences that flank a transposase, PBase. PBase recognizes the terminal repeats and induces transposition via a "cut-and-paste" based mechanism, and preferentially transposes into the host genome at the tetranucleotide sequence TTAA. Upon insertion, the TTAA target site is duplicated such that the PB transposon is flanked by this tetranucleotide sequence. When mobilized, PB typically excises itself precisely to reestablish a single TTAA site, thereby restoring the host sequence to its pre-transposon state. After excision, PB can transpose into a new location or be permanently lost from the genome. Typically, the transposase system offers an alternative means for the removal of selection cassettes after homologous recombination quit similar to the use Cre/Lox or Flp/FRT. Thus, for example, the PB transposase system involves introduction of a targeting vector with 3' and 5' homology arms containing the mutation of interest, two PB terminal repeat sequences at the site of an endogenous TTAA sequence and a selection cassette placed between PB terminal repeat sequences. Positive selection is applied and homologous recombinants that contain targeted mutation are identified. Transient expression of PBase removes in conjunction with negative selection results in the excision of the selection cassette and selects for cells where the cassette has been lost. The final targeted allele contains the introduced mutation with no exogenous sequences.

For PB to be useful for the introduction of sequence alterations, there must be a native TTAA site in relatively close proximity to the location where a particular mutation is to be inserted.

Homology Directed Repair (HDR)

Homology Directed Repair (HDR) can be used to generate specific nucleotide changes (also known as gene "edits") ranging from a single nucleotide change to large insertions. In order to utilize HDR for gene editing, a DNA "repair template" containing the desired sequence must be delivered into the cell type of interest with e.g. the guide RNA [gRNA(s)] and Cas9 or Cas9 nickase or other genome editing method (examples herein below). The repair template must contain the desired edit as well as additional homologous sequence immediately upstream and downstream of the target (termed left and right homology arms). The length and binding position of each homology arm is dependent on the size of the change being introduced. The repair template can be a single stranded oligonucleotide, double-stranded oligonucleotide, or double-stranded DNA plasmid depending on the specific application.

The HDR method was successfully used for targeting a specific modification in a coding sequence of a gene in plants [Budhagatapalli Nagaveni et al. (2015) "Targeted Modification of Gene Function Exploiting Homology-Directed Repair of TALEN-Mediated Double-Strand Breaks in Barley". G3 (Bethesda). 5(9): 1857-1863). Thus, the gfp-specific transcription activator-like effector nucleases were used along with a repair template that, via HDR, facilitates conversion of gfp into yfp, which is associated with a single amino acid exchange in the gene product. The resulting yellow-fluorescent protein accumulation along with sequencing confirmed the success of the genomic editing.

Similarly, Zhao Yongping et al. 2016 (An alternative strategy for targeted gene replacement in plants using a dual-sgRNA/Cas9 design. Scientific Reports 6, Article number: 23890 (2016)) describe co-transformation of *Arabidopsis* plants with a combinatory dual-sgRNA/Cas9 vector that successfully deleted miRNA gene regions (MIR169a and MIR827a) and second construct that contains sites homologous to *Arabidopsis* TERMINAL FLOWER 1 (TFL1) for homology-directed repair (HDR) with regions corresponding to the two sgRNAs on the modified construct to provide both targeted deletion and donor repair for targeted gene replacement by HDR.

Specific considerations for Homology Directed Repair (HDR) utilizing CRISPR/Cas9 system are described herein: It should be noted that the repair template should not include a sequence that exhibits more than 90% identity to the gRNA designed to the genomic DNA or to the reverse complement sequence of the gRNA which is designed to the genomic sequence, otherwise the repair template becomes a suitable target for Cas9 cleavage. Additionally or alternatively, when using a short repair template (e.g., about 40-200 base pairs) the repair template should preferably lack the Protospacer Adjacent Motif (PAM) sequence. For example, the PAM could be mutated such that it is no longer present, but the coding region of the gene is not affected (i.e. a silent mutation).

Introduction of large double stranded DNA as repair template can be performed using plasmids, yet, the plasmid should be linearized before transfection.

Activation of Target Genes Using CRISPR/Cas9 System

Many bacteria and archea contain endogenous RNA-based adaptive immune systems that can degrade nucleic acids of invading phages and plasmids. These systems consist of clustered regularly interspaced short palindromic repeat (CRISPR) genes that produce RNA components and CRISPR associated (Cas) genes that encode protein components. The CRISPR RNAs (crRNAs) contain short stretches of homology to specific viruses and plasmids and act as guides to direct Cas nucleases to degrade the complementary nucleic acids of the corresponding pathogen. Studies of the type II CRISPR/Cas system of *Streptococcus pyogenes* have shown that three components form an RNA/protein complex and together are sufficient for sequence-specific nuclease activity: the Cas9 nuclease, a crRNA containing 20 base pairs of homology to the target sequence, and a trans-activating crRNA (tracrRNA) (Jinek et al. Science (2012) 337: 816-821). It was further demonstrated that a synthetic chimeric guide RNA (gRNA) composed of a fusion between crRNA and tracrRNA could direct Cas9 to cleave DNA targets that are complementary to the crRNA in vitro. It was also demonstrated that transient expression of CRISPR-associated endonuclease (Cas9) in conjunction with synthetic gRNAs can be used to produce targeted double-stranded brakes in a variety of different species.

The CRISPR/Cas9 system is a remarkably flexible tool for genome manipulation. A unique feature of Cas9 is its ability to bind target DNA independently of its ability to cleave target DNA. Specifically, both RuvC- and HNH-nuclease domains can be rendered inactive by point mutations (D10A and H840A in SpCas9), resulting in a nuclease dead Cas9 (dCas9) molecule that cannot cleave target DNA. The dCas9 molecule retains the ability to bind to target DNA based on the gRNA targeting sequence. The dCas9 can be tagged with transcriptional activators, and targeting these dCas9 fusion proteins to the promoter region results in robust transcription activation of downstream target genes. The simplest dCas9-based activators consist of dCas9 fused directly to a single transcriptional activator. Importantly, unlike the genome modifications induced by Cas9 or Cas9 nickase, dCas9-mediated gene activation is reversible, since it does not permanently modify the genomic DNA.

Indeed, genome editing was successfully used to over-express a protein of interest in a plant by, for example, mutating a regulatory sequence, such as a promoter to overexpress the endogenous polynucleotide operably linked to the regulatory sequence. For example, U.S. Patent Application Publication No. 20160102316 to Rubio Munoz, Vicente et at, describes plants with increased expression of an endogenous DDA1 plant nucleic acid sequence wherein the endogenous DDA1 promoter carries a mutation introduced by mutagenesis or genome editing which results in increased expression of the DDA1 gene, using for example, CRISPR. The method involves targeting of Cas9 to the specific genomic locus, in this case DDA1, via a 20 nucleotide guide sequence of the single-guide RNA. An online CRISPR Design Tool can identify suitable target sites (tools.genome-engineering.org; Ran et al. (2013) Nature Protocols, 8911: 2281-2308).

The CRISPR-Cas system was used for altering (increasing or decreasing) gene expression in plants as described in U.S. Patent Application publication No. 20150067922 to Yang; Yinong et al. The engineered, non-naturally occurring gene editing system comprises two regulatory elements, wherein the first regulatory element (a) operable in a plant cell operably linked to at least one nucleotide sequence encoding a CRISPR-Cas system guide RNA (gRNA) that hybridizes with the target sequence in the plant, and a second regulatory element (b) operable in a plant cell operably linked to a nucleotide sequence encoding a Type-II CRISPR-associated nuclease, wherein components (a) and (b) are located on same or different vectors of the system, whereby the guide RNA targets the target sequence and the CRISPR-associated nuclease cleaves the DNA molecule, thus altering the expression of a gene product in a plant. It should be noted that the CRISPR-associated nuclease and the guide RNA do not naturally occur together.

In addition, as described above, point mutations which activate a gene-of-interest and/or which result in over-expression of a polypeptide-of-interest can be also introduced into plants by means of genome editing. Such mutation can be for example, deletions of repressor sequences which result in activation of the gene-of-interest; and/or mutations which insert nucleotides and result in activation of regulatory sequences such as promoters and/or enhancers.

According to additional aspect, the present invention provides a genetically engineered plant having enhanced resistance to at least one fungus and/or Oomycete compared to a non-engineered control plant, the genetically engineered plant comprises at least one cell having modified expression and/or activity of at least one polypeptide at least 80% identical to a polypeptide having an amino acid sequence selected from the group consisting of SEQ ID NOs:571-939 compared to the polypeptide expression and/or activity in the non-engineered control plant. Each possibility represents a separate embodiment of the present invention.

According to certain embodiments, the genetically engineered plant comprises at least one cell having modified expression and/or activity of at least one polypeptide having the amino acid sequences selected from the group consisting of SEQ ID NOs:571-964. Each possibility represents a separate embodiment of the present invention.

According to certain embodiments, the genetically engineered plant having enhanced resistance to the at least one fungus and/or Oomycete comprises at least one cell with enhanced expression and/or activity of the at least one polypeptide.

According to certain embodiments, the genetically engineered plant comprises at least one cell transformed with an exogenous polynucleotide encoding the at least one polypeptide, thereby having an enhanced resistance to the at least one fungus. The exogenous polynucleotide can be endogenous to the plant cell or heterologous to the plant cell.

According to certain embodiments, the genetically engineered plant comprises at least one cell edited to express an exogenous polynucleotide encoding the at least one polypeptide, thereby having an enhanced resistance to the at least one fungus.

According to certain embodiments, the genetically engineered plant comprises at least one cell edited to over-express an endogenous polynucleotide encoding the at least one polypeptide, thereby having an enhanced resistance to the at least one fungus.

According to certain embodiments, the genetically engineered plant having enhanced resistance to the at least one fungus comprises at least one cell with enhanced expression of a polynucleotide encoding the at least one polypeptide. According to certain exemplary embodiments, the polynucleotide expression in the genetically engineered plant is enhanced in comparison to the polynucleotide expression in a control plant.

According to certain exemplary embodiments, the at least one polypeptide having enhanced expression and/or activity comprises an amino acid sequence selected from the group consisting of SEQ ID NOs: 573, 575-578, 585, 586, 589, 592-594, 600, 607, 609-611, 614, 629-632, 635, 641, 642, 645, 651-654, 942, and 943. Each possibility represents a separate embodiment of the present invention. According to certain embodiments, the at least one polypeptide is encoded by a polynucleotide having a nucleic acid sequence selected from the group consisting of SEQ ID NOs: 57, 59-62, 69, 70, 73, 76-78, 84, 91, 93-95, 98, 113-116, 119, 123, 125-128, 135, 136, 138, 141-143, 149, 156, 158-160, 162, 177-180, 183, 530, 531, 535, and 536.

According to certain embodiments, the genetically engineered plant having enhanced resistance to the at least one fungus comprises at least one cell with reduced expression and/or activity of the at least one polypeptide. According to certain exemplary embodiments, the polypeptide expression and/or activity in the genetically engineered plant is reduced in comparison to the polypeptide expression and/or activity in a control plant.

According to certain embodiments, the genetically engineered plant having reduced expression and/or activity of the at least one polypeptide comprises at least one cell having reduced expression of a polynucleotide encoding said at least one polypeptide, thereby having an enhanced resistance to the at least one fungus.

According to certain embodiments, the genetically engineered plant comprises a polynucleotide encoding a modified form of the at least one polypeptide, wherein the modified form has reduced or no activity compared to the unmodified form, thereby having an enhanced resistance to the at least one fungus.

According to certain exemplary embodiments, the polypeptide the expression of which is reduced comprises an amino acid sequence selected from the group consisting of SEQ ID NOs:590, 603 and 619. Each possibility represents a separate embodiment of the present invention. According to certain embodiments, the polypeptide is encoded by a polynucleotide comprising a nucleic acid sequence selected from the group consisting of SEQ ID NOs: 74, 87, 103, 139, 152, and 167. Each possibility represents a separate embodiment of the present invention.

According to additional aspect, the present invention provides a genetically engineered plant having enhanced resistance to at least one fungus and/or Oomycete compared to a control plant, the genetically engineered plant comprises at least one cell having modified expression and/or activity of at least one polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to a polypeptide having an amino acid sequence selected from the group consisting of SEQ ID NOs:571-939 compared to the polypeptide expression and/or activity in a control plant. Each possibility represents a separate embodiment of the present invention.

According to certain embodiments, the genetically engineered plant comprises at least one cell having modified expression and/or activity of at least one polypeptide having the amino acid sequence selected from the group consisting of SEQ ID NOs:571-964. Each possibility represents a separate embodiment of the present invention.

According to certain embodiments, the genetically engineered plant comprises at least one cell having modified expression of a polynucleotide encoding the at least one polypeptide.

According to additional aspect, the present invention provides a genetically engineered plant having enhanced resistance to at least one fungus and/or Oomycete compared to a control plant, the genetically engineered plant comprises at least one cell having modified expression of at least one polynucleotide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to a polynucleotide having an nucleic acid sequence selected from the group consisting of SEQ ID NOs:55-527 compared to the polynucleotide expression and/or activity in a control plant. Each possibility represents a separate embodiment of the present invention.

According to certain embodiments, the genetically engineered plant comprises at least one cell having modified expression of at least one polynucleotide having the nucleic acid sequence selected from the group consisting of SEQ ID NOs:55-564. Each possibility represents a separate embodiment of the present invention.

According to certain embodiments, modified expression/and or activity of the polypeptide or polynucleotide encoding same comprises enhanced expression and/or activity. According to certain embodiments, modified expression/and or activity of the polypeptide or polynucleotide encoding same comprises reduced expression and/or activity.

According to certain aspects, the present invention provide a genetically engineered plant having enhanced resistance to at least one fungus and/or Oomycete compared to a control plant, the genetically engineered plant comprises at least one cell having enhanced expression and/or activity of at least one polypeptide having an amino acid sequence selected from the group consisting of SEQ ID NOs: 573, 575-578, 585, 586, 589, 592-594, 600, 607, 609-611, 614, 629-632, 635, 641, 642, 645, 651-654, 942, and 943. Each possibility represents a separate embodiment of the present invention.

According to certain embodiments, the at least one polypeptide is encoded by a polynucleotide having a nucleic acid sequence selected from the group consisting of SEQ ID NOs: 57, 59-62, 69, 70, 73, 76-78, 84, 91, 93-95, 98, 113-116, 119, 123, 125-128, 135, 136, 138, 141-143, 149, 156, 158-160, 162, 177-180, 183, 530, 531, 535, and 536. Each possibility represents a separate embodiment of the present invention.

According to certain embodiments, the genetically engineered plant having enhanced resistance to the at least one fungus and/or Oomycete comprises at least one cell with reduced expression and/or activity of at least one polypeptide. According to certain exemplary embodiments, the polypeptide expression and/or activity in the genetically engineered plant is reduced in comparison to the polypeptide expression and/or activity in a control plant.

According to certain embodiments, the genetically engineered plant having reduced expression and/or activity of the at least one polypeptide comprises at least one cell having reduced expression of a polynucleotide encoding said at least one polypeptide, thereby having an enhanced resistance to the at least one fungus.

According to certain embodiments, the genetically engineered plant comprises a polynucleotide encoding a modified form of the at least one polypeptide, wherein the modified form has reduced or no activity compared to the unmodified form, thereby having an enhanced resistance to the at least one fungus.

According to certain exemplary embodiments, the polypeptide the expression of which is reduced comprises an amino acid sequence selected from the group consisting of SEQ ID NOs:590, 603 and 619. Each possibility represents a separate embodiment of the present invention. According to certain embodiments, the polypeptide is encoded by a polynucleotide comprising a nucleic acid sequence selected from nth e group consisting of SEQ ID NOs:74, 87, 103, 139, 152, and 167. Each possibility represents a separate embodiment of the present invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a safe and cost effective manner in a wide range of economical plants, exemplary species of which are described hereinabove.

It will be appreciated that some genes involved in a plant defense mechanisms conferring resistance to a particular fungus species may also be involved in resistance to other species, regulated by the same or homologous genes. Of course, the overall defense mechanism is related, not identical, and therefore not all genes involved in resistance to one pathogen will confer resistance to other pathogens. Nonetheless, if a gene confers or enhances resistance to one of the pathogen species, it would be apparent to one skilled in the art to test for resistance to other pathogens, specifically to pathogen of the same genus or that cause similar symptoms.

According to certain embodiments, the fungus and/or Oomecete is selected from, but not limited to, *Fusarium verticillioides; Fusarium graminearum*; Collotetrichum graminicola; *Fusarium avenaceum; Fusarium culmorum; Fusarium oxysporum; Fusarium roseum; Fusarium semitectum; Fusarium solani; Fusarium verticillioides; Fusarium verticillioides* var. *subglutinans; Acremonium strictum; Albugo candida; Albugo tragopogonis; Alternaria alternate; Alternaria brassicae; Alternaria helianthi; Alternaria zinnia; Aphanomyces euteiches; Ascochyta sorghina; Ascochyta tritici; Aspergillus flavus; Bipolaris maydis* O; *Bipolaris sorghicola; Bipolaris sorokiniana; Botrytis cinerea; Cephalosporium acremonium; Cephalosporium gramineum; Cephalosporium maydis; Cercospora kikuchii; Cercospora medicaginis; Cercospora sojina; Cercospora sorghi; Cladosporium herbarum; Clavibacter michiganense* subsp. *Nebraskense; Clavibacter michiganese* subsp. *Insidiosum; Claviceps purpurea; Claviceps sorghi; Cochliobolus heterostrophus; Colletotrichum dematium* (*Colletotichum truncatum*); *Colletotrichum* trifolii; *Colletotrichum sublineolum*; Corn stunt *spiroplasma; Corynespora cassiicola; Curvularia inaequalis; Curvularia lunata; Curvularia pallescens; Diaporthe phaseolorum* var. *caulivora; Diaporthe phaseolorum* var. *sojae* (*Phomopsis sojae*); *Diplodia macrospora; Erwinia carotovora; Erwinia carotovorum* pv. *Carotovora; Erwinia chrysanthemi* pv. *Zea; Erwinia stewartii; Erysiphe cichoracearum; Erysiphe graminis* fsp. *tritici; Exserohilum turcicum* I, II & III; *Gaeumannomyces graminis* var. *tritici; Gibberella zeae* (*Fusarium graminearum*); *Gloeocercospora sorghi; Glomerella glycines; Helminthosporium carbonum* I, II & III (*Cochliobolus carbonum*); *Helminthosporium pedicellatum; Helminthosporium sorghicola; Kabatiella maydis; Leptosphaeria maculans; Leptosphaerulina briosiana; Leptotrichila medicaginis; Macrophomina phaseolina; Microsphaera diffusa; Mycosphaerella brassicicola; Nigrospora oryzae; Penicillium oxalicum; Perconia circinata; Peronosclerospora maydis; Peronosclerospora philippinensis; Peronosclerospora sacchari; Peronosclerospora sorghi; Peronospora manshurica; Peronospora parasitica; Peronospora trifoliorum; Phakopsora pachyrhizi; Phialophora gregata; Phoma insidiosa; Phoma macdonaldii; Phoma medicaginis* var. *medicaginis; Phomopsis helianthi; Phyllachara sacchari; Phyllosticta maydis; Phyllosticta sojicola; Physoderma maydis; Physopella zeae; Phytophthora cryptogea; Phytophthora megasperma; Phytophthora megasperma* fsp. *Glycinea; Plasmopora halstedii; Pseudocercosporella heipotrichoides; Pseudomonas andropogonis; Pseudomonas avenae; Pseudomonas avenae* (*Pseudomonas alboprecipitans*); *Pseudomonas syringae* p.v. *atrofaciens; Pseudomonas syringae* p.v. *glycinea; Pseudomonas syringae* p.v. *syringae; Pseudopeziza medicaginis; Puccinia graminis* fsp. *tritici; Puccinia helianthi; Puccinia polysora; Puccinia purpurea; Puccinia recondita* fsp. *tritici; Puccinia sorghi; Puccinia striiformis; Pyrenophora tritici-repentis; Pythium aphanidermatum; Pythium arrhenomanes; Pythium debaryanum; Pythium gramicola; Pythium graminicola; Pythium* irregular; *Pythium splendens; Pythium ultimum; Ramulispora sorghi; Ramulispora sorghicola; Rhizoctonia cerealis; Rhizoctonia solani; Rhizopus arrhizus; Rhizopus oryzae; Rhizopus stolonifera; Sclerophthona macrospora; Sclerospora graminicola; Sclerotinia sclerotiorum; Sclerotinia trifoliorum; Sclerotium rolfsii; Septoria avenae; Septoria glycines; Septoria helianthi; Septoria nodorum; Septoria tritici; Exserohilum turcicum; Sphacelotheca cruenta; Sporisorium reilianum* (*Sphacelotheca reiliana*); *Sporisorium sorghi; Stagonospora meliloti; Stemphylium alfalfa; Stemphylium botryosum; Stemphylium herbarum; Stenocarpella maydi* (*Diplodia maydis*); *Tilletia indica; Tilletia laevis; Tilletia tritici; Trichoderma viride; Urocystis agropyri; Uromyces striatus; Ustilago maydis; Ustilago tritici; Verticillium albo-atrum; Verticillium dahlia; Xanthomonas campestris* p.v. *alfalfa; Xanthomonas campestris* p.v. *holcicola; Xanthomonas campestris* p.v. *phaseoli*; and *Xanthomonas campestris* p.v. *translucens*. Each possibility represents a separate embodiment of the present invention.

Specific pathogenic fungi or Oomycetes are known to cause dramatic crop lose due to disease symptoms which negatively affect the quality of the crop. For example, *Fusarium verticilloides* and *Fusarium graminearum* cause rot in maize (specifically stalk rot), wheat, sweet paper, eggplants and and head blight is wheat. *Fusarium oxyspo-*

*rum* causes sudden death syndrome (SDS) in soybeans, yellow spots in sugar beet, Panama disease in Banana, and wilt in tomato, sweet pepper, eggplants, potatoes and various plant of the Cucurbitaceae family. *Colletorichum* spp. cause stalk rot in maize, anthracnose in sugar beet, tomato and sweet pepper. *Botrytis cinerea* causes gray mold in tomato, sweet pepper, eggplants and potato. Rust is caused by *Puccinia* spp. in maize, wheat and sunflower, by *Uromyces* spp. in sunflower and by *Phakopsora* in soybean. *Phytopthora* causes root rot in soybean, late blight in tomato and potato, blight in eggplant and blight fruit rot in sweet pepper. *Mycosphaerella graminicola* causes leaf blotch in wheat. *Mycosphaerella fijiensis* causes black leaf streak disease (BLSD; aka black Sigatoka leaf spot) in banana. *Septoria lycopersici* causes leaf spots in tomato. *Verticillium* spp. cause wilt disease in canola, sugar beet, tomato, sweet pepper, eggplant and potato. *Magnaporthe oryza* causes rice blast. *Phytium* spp. cause damping off disease in maize, soybean, tomato, sweet pepper, eggplant and potato and black vessels in sugar beet. *Sclerotinia* causes stem rot in soybean and white mold in tomato, sweet pepper, eggplant and potato. *Rhizoctonia solani* causes root crown rot in sugar beet, sheath blight in rice, and damping off disease in tomato, sweet pepper, eggplant and potato. Maize smut is caused by *Ustilago maydis*. *Alternaria* spp. cause leaf spots in sugar beet and sweet pepper, early blight in tomato and potato, and fruit rot in sweet pepper and eggplants. *Cercospora* causes leaf blight in soybean and leaf spots in sugar beet, sweet pepper, eggplants and potato. *Macrophomina* causes charcoal rot in maize, wheat, soybean, tomato and potato. *Sclerotium rolfsii* causes Southern blight in sweet pepper and eggplants. *Oidium* spp. cause powdery mildew in tomato, sweet pepper, eggplants and potato. Powdery mildew is also caused by *Blumeria graminis*.

Methods for identifying symptoms caused by various fungi and Oomycetes upon infection of specific plant species, and for measuring the degree of the plant susceptibility/resistance to the infection are well known to those skilled in the art.

The term "plant" as used herein encompasses a whole plant, a grafted plant, ancestor(s) and progeny of the plants and plant parts, including seeds, shoots, stems, roots (including tubers), rootstock, scion, and plant cells, tissues and organs. The plant or part thereof may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorycnium rectum, Echinochloa pyramidalis, Ehraffia* spp., *Eleusine coracana, Eragrestis* spp., *Erythrina* spp., *Eucalypfus* spp., *Euclea schimperi, Eulalia vi/losa, Pagopyrum* spp., *Feijoa sellowlana, Fragaria* spp., *Flemingia* spp, *Freycinetia banksli, Geranium thunbergii, GinAgo biloba, Glycine javanica, Gliricidia* spp, *Gossypium hirsuturn, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, *eucalyptus*, a tree, an ornamental plant, a perennial grass and a forage crop. Alternatively algae and other non-Viridiplantae can be used for the methods of the present invention.

According to some embodiments, the plant used according to the teachings of the present invention is a crop plant such as rice, maize, wheat, barley, peanut, potato, sesame, olive tree, palm oil, banana, soybean, sunflower, canola, sugarcane, alfalfa, millet, leguminosae (bean, pea), flax, *lupinus*, rapeseed, tobacco, poplar and cotton.

According to some embodiment, the plant used according to the teachings of the present invention is a field crop plant selected from the group consisting of tomato, potato, sweet potato, cassava, beets, ginger, horseradish, radish, *ginseng*, turnip, any root or tuber crop, pepper, eggplant, ground cherry, tomatillo, okra, other fruiting vegetables, cucumber cantaloupe, melon, muskmelon, squash, watermelon and other cucurbit plants.

According to some embodiments of the invention the plant is a dicotyledonous plant.

According to some embodiments of the invention the plant is a monocotyledonous plant.

According to some embodiments the present invention provides a plant cell expressing the exogenous polynucleotide of some embodiments of the invention, the nucleic acid construct comprising the exogenous polynucleotide of some embodiments of the invention and/or the polypeptide of some embodiments of the invention.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

The following examples are presented in order to more fully illustrate some embodiments of the invention. They should, in no way be construed, however, as limiting the broad scope of the invention. One skilled in the art can readily devise many variations and modifications of the principles disclosed herein without departing from the scope of the invention.

EXAMPLES

Example 1: Fungal Resistance—Genes Identification

The inventors of the present invention have identified polynucleotides related to resistant to fungal infection, particularly to infection by *Fusarium verticilloides, Fusarium graminearum* or *Colletotrichum graminicola*. Expression of the polynucleotide in plants can increase the plant resistance to fungal infection.

The nucleotide sequence datasets used for the polynucleotide identification were originated from publicly available databases as well as from Applicant proprietary sequencing data obtained using the Solexa technology (form e.g. wheat, maize and *sorghum*). Sequence data from 200 different plant species was introduced into a single, comprehensive database. The information used to build the datasets included gene expression levels, protein annotation, enzymatic activity and involvement in biosynthetic pathways.

Major databases used included:

Genomic Databases

*Arabidopsis* genome [TAIR genome version 6 (arabidopsis.org/)];

Rice genome [IRGSP build 4.0 (rgp.dna.affrc.go.jp/IRGSP/)];

Poplar [*Populus trichocarpa* release 1.1 from JGI (assembly release v1.0) (genome.jgi-psf.org/)];

*Brachypodium* [JGI 4× assembly, brachpodium.org)];

Soybean [DOE-JGI SCP, version Glyma0 (phytozome.net/)];

Grape [French-Italian Public Consortium for Grapevine Genome Characterization grapevine genome (genoscope.cns.fr/)];

Castorbean [TIGR/J Craig Venter Institute 4× assembly [msc.jcvi.org/r communis];

*Sorghum* [DOE-JGI SCP, version Sbi1 [phytozome.net/)]; and

Maize “B73” [DOE-JGI SCP, version AGPv2 [phytozome.net/)];

Databases of Expressed EST and mRNA Sequences:

GenBank ncbi.nlm.nih.gov/dbEST;

RefSeq (ncbi.nlm.nih.gov/RefSeq/);

TAIR (arabidopsis.org/);

Protein and Pathway Databases:

Uniprot [uniprotorg/];

AraCyc [arabidopsis.org/biocyc/index.jsp];

ENZYME [expasy.org/enzyme/];

Microarray datasets were downloaded from: GEO (ncbi.nlm.nih.gov/geo/); TAIR (arabidopsis.org/); and Applicant proprietary microarray data as described in PCT Patent Application Publication No. WO 2008/122980.

QTL and SNPs information was retrieved from Gramene [gramene.org/qtl/]; and Panzea [panzea.org/index.html].

Database Assembly

Database assembly was performed to build a wide, rich, reliable annotated and easy to analyze database. The assembly comprised data retrieved from publicly available genomic sequences, mRNA sequences, ESTs DNA sequences and QTL data, as well as information regarding gene expression, protein annotation, and involvement in biosynthesis pathway, all in various plant types. The assembly further comprised data retrieved from Applicant proprietary databases produced from various plant types including genomic sequences, mRNA sequences, expression, proteomic and metabolomic data, QTL (quantitative trait loci) and GWAS (genome-wide association studies) data.

Database assembly is comprised of a toolbox of gene refining, structuring and annotation as well as analysis tools enabling to construct a tailored database for each gene discovery project. Gene refining and structuring tools enable to reliably detect splice variants and antisense transcripts, and understand various potential phenotypic outcomes of a single gene. The capabilities of the “LEADS” platform of Compugen LTD. for analyzing human genome have been confirmed and accepted by the scientific community [see e.g., “Widespread Antisense Transcription”, Yelin, et al. (2003) Nature Biotechnology 21, 379-85; “Splicing of Alu Sequences”, Lev-Maor, et al. (2003) Science 300 (5623), 1288-91; “Computational analysis of alternative splicing using EST tissue information”, Xie H et al. Genomics 2002], and have been proven most efficient in plant genomics as well.

EST Clustering and Gene Assembly

For gene clustering and assembly of organisms with available genome sequence data (*Arabidopsis*, rice, castorbean, grape, *Brachypodium*, poplar, soybean, *sorghum*) the genomic LEADS version (GANG) was employed. This tool allows most accurate clustering of ESTs and mRNA sequences on genome, and predicts gene structure as well as alternative splicing events and antisense transcription.

For organisms with no available full genome sequence data, “expressed LEADS” clustering software was applied.

Gene Annotation

Predicted genes and proteins were annotated as follows: BLAST™ search [blast.ncbi.nlm.nih.gov/Blast.cgi] against all plant UniProt [uniprot.org/] sequence was performed. Open reading frames (ORFs) of each putative transcript were analyzed and longest ORF with highest number of homologues was selected as a predicted protein of the transcript. The predicted proteins were analyzed by InterPro [ebi.ac.uk/interpro/].

BLAST™ against proteins from AraCyc and ENZYME databases was used to map the predicted transcripts to AraCyc pathways.

Predicted proteins from different species were compared using BLAST™ algorithm [ncbi.nlm nih.gov/Blast.cgi] to validate the accuracy of the predicted protein sequence, and for efficient detection of orthologs.

Gene Expression Profiling

Several data sources were exploited for gene expression profiling, namely microarray data and digital expression profile (see below). Genes were analyzed for expression patterns in different plant species and varieties. The analysis was based on differential expression under uninfected and infected conditions, wherein the infection was induced by different pathogens and the gene expression was measured in different plant organs and at different time points along the disease development. Publicly available microarray datasets were downloaded from TAIR and NCBI GEO sites, renormalized, and integrated into the database. Expression profiling is one of the most important resource data for identifying genes related to disease resistance.

A digital expression profile summary was compiled for each gene cluster according to all keywords included in the sequence records comprising the cluster. Digital expression, also known as electronic Northern Blot, is a tool that displays virtual expression profile based on the expressed sequence tag (EST) sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis of The Melon Fruit Transcriptome Based on 454 Pyrosequencing, in: Plant & Animal Genomes XVII Conference, San Diego, Calif.). Transcriptomeic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [icugi.org/] confirmed the accuracy of the sequencing and assembly. Expression patterns of selected genes fitted well their qRT-PCR data.

The genes listed in Table 1 below were identified as candidates to have a major impact on plant resistance to at least one of *Fusarium* verticilloides, *Fusarium* graminearum and *Colletotrichum* graminicola when expression thereof is increased in plants. The identified gene name, the plant from which it derived, and the amino acid and nucleic acid sequences of each gene are summarized in Table 1, herein below.

TABLE 1

Genes associated with plant resistance to fungal pathogens

| Gene Name | Organism | Polyn SEQ ID NO: | Polyp. SEQ ID NO: |
|---|---|---|---|
| LAB511 | *Zea mays* | 565 | 965 |
| LFS2 | *Hordeum vulgare* | 55 | 571 |
| LFS3 | *Hordeum vulgare* | 56 | 572 |
| LFS4 | *Hordeum vulgare* | 57 | 573 |
| LFS6 | *Hordeum vulgare* | 58 | 574 |
| LFS7 | *Hordeum vulgare* | 59 | 575 |
| LFS8 | *Hordeum vulgare* | 60 | 576 |
| LFS9 | *Hordeum vulgare* | 61 | 577 |
| LFS10 | *Hordeum vulgare* | 62 | 578 |
| LFS11 | *Zea mays* | 63 | 579 |
| LFS13 | *Zea mays* | 64 | 580 |
| LFS14 | *Zea mays* | 65 | 581 |
| LFS15 | *Zea mays* | 66 | 582 |
| LFS16 | *Zea mays* | 67 | 583 |
| LFS17 | *Zea mays* | 68 | 584 |
| LFS18 | *Zea mays* | 69 | 585 |
| LFS19 | *Zea mays* | 70 | 586 |
| LFS21 | *Zea mays* | 71 | 587 |
| LFS22 | *Zea mays* | 528 | 940 |
| LFS23 | *Zea mays* | 72 | 588 |
| LFS24 | *Zea mays* | 73 | 589 |
| LFS25 | *Zea mays* | 74 | 590 |
| LFS26 | *Zea mays* | 75 | 591 |
| LFS27 | *Zea mays* | 76 | 592 |
| LFS28 | *Zea mays* | 529 | 966 |
| LFS29 | *Zea mays* | 77 | 593 |
| LFS30 | *Zea mays* | 78 | 594 |
| LFS31 | *Zea mays* | 79 | 595 |
| LFS32 | *Zea mays* | 80 | 596 |
| LFS33 | *Zea mays* | 81 | 597 |
| LFS34 | *Zea mays* | 82 | 598 |
| LFS35 | *Zea mays* | 83 | 599 |
| LFS36 | *Zea mays* | 84 | 600 |
| LFS37 | *Zea mays* | 85 | 601 |
| LFS38 | *Zea mays* | 86 | 602 |
| LFS39 | *Zea mays* | 87 | 603 |
| LFS40 | *Zea mays* | 530 | 941 |
| LFS42 | *Zea mays* | 88 | 604 |
| LFS43 | *Zea mays* | 89 | 605 |
| LFS44 | *Zea mays* | 90 | 606 |
| LFS45 | *Sorghum bicolor* | 91 | 607 |
| LFS46 | *Sorghum bicolor* | 92 | 608 |
| LFS47 | *Sorghum bicolor* | 93 | 609 |
| LFS48 | *Sorghum bicolor* | 531 | 942 |
| LFS49 | *Sorghum bicolor* | 94 | 610 |
| LFS50 | *Sorghum bicolor* | 95 | 611 |
| LFS51 | *Sorghum bicolor* | 96 | 612 |
| LFS52 | *Sorghum bicolor* | 97 | 613 |
| LFS53 | *Sorghum bicolor* | 98 | 614 |
| LFS54 | *Sorghum bicolor* | 99 | 615 |
| LFS55 | *Sorghum bicolor* | 100 | 616 |
| LFS57 | *Sorghum bicolor* | 101 | 617 |
| LFS58 | *Sorghum bicolor* | 102 | 618 |
| LFS59 | *Sorghum bicolor* | 103 | 619 |
| LFS60 | *Sorghum bicolor* | 104 | 620 |
| LFS61 | *Sorghum bicolor* | 105 | 621 |
| LFS62 | *Sorghum bicolor* | 106 | 622 |
| LFS65 | *Sorghum bicolor* | 107 | 623 |
| LFS66 | *Sorghum bicolor* | 108 | 624 |
| LFS67 | *Triticum aestivum* | 109 | 625 |
| LFS68 | *Triticum aestivum* | 110 | 626 |
| LFS70 | *Triticum aestivum* | 111 | 627 |
| LFS71 | *Triticum aestivum* | 112 | 628 |
| LFS72 | *Triticum aestivum* | 113 | 629 |
| LFS73 | *Triticum aestivum* | 114 | 630 |
| LFS74 | *Triticum aestivum* | 115 | 631 |
| LFS75 | *Triticum aestivum* | 116 | 632 |
| LFS76 | *Triticum aestivum* | 117 | 633 |
| LFS77 | *Triticum aestivum* | 118 | 634 |
| LFS78 | *Triticum aestivum* | 119 | 635 |
| LFS79 | *Hordeum vulgare* | 532 | 967 |
| LFS80 | *Zea mays* | 120 | 636 |

"polyn." = polynucleotide; "polyp." = polypeptide.

Example 2: Fungal Resistance—Identification of Homologous Sequences

The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To further investigate and identify putative orthologs of the genes identified to affect plant resistance to *Fusarium verticilloides, Fusarium graminearum* or *Colletotrichum graminicola*, all sequences were aligned using the BLAST™ (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data were analyzed and the EST libraries were classified using a fixed vocabulary of custom terms such as developmental stages (e.g., genes showing similar expression profile through development with up-regulation at specific stage, such as at seed germination, time points during seedling growth and at maturity) and/or plant organ (e.g., genes showing similar expression profile across their organs with up-regulation at specific organs such as roots and stems). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, including similarities in the sequence level—identical amino acids in the protein domains and similarity in expression profiles.

The search and identification of homologous genes involves the screening of sequence information available, for example, in public databases such as the DNA Database of Japan (DDBJ), GenBank, and the European Molecular Biology Laboratory Nucleic Acid Sequence Database (EMBL) or versions thereof or the MIPS database. A number of different search algorithms have been developed, including but not limited to the suite of programs referred to as BLAST™ programs There are five implementations of BLAST™, three designed for nucleotide sequence queries (BLASTN, BLASTX, and TBLASTX) and two designed for protein sequence queries (BLASTP and TBLASTN) (Altschul, S. F et al., (1990) "Basic local alignment search tool." J. Mol. Biol. 215:403-410). Such methods involve alignment and comparison of sequences. The BLAST™ algorithm calculates percent sequence identity and performs a statistical analysis of the similarity between the two sequences. The software for performing BLAST™ analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbor-joining tree of the proteins homologous to the proteins encoded by the genes identified in this invention may be used to provide an overview of structural and ancestral relationships. Sequence identity may be calculated using an alignment program as described above. It is expected that plants other that those examined in the present invention will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), *Arabidopsis* (*Arabidopsis thaliana*), maize (*Zea mays*), cotton (*Gossypium*), Oilseed rape (*Brassica napus*), Rice (*Oryza sativa*), Sugar cane (*Saccharum officinarum*), *Sorghum* (*Sorghum bicolor*), Soybean (*Glycine max*), Sunflower (*Helianthus annuus*), Tomato (*Lycopersicon esculentum*), and Wheat (*Triticum aestivum*).

The above-mentioned analyses for sequence homology can be carried out on a full-length sequence, but may also be based on a comparison of certain regions such as conserved domains. The identification of such domains would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (biochem.ucl.ac.uk/bsm/dbbrowser/protocol/prodomqry.html), PIR (pir.Georgetown.edu/) or Pfam (sanger.ac.uk/Software/Pfam/) databases. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break α-helical structures or β-sheet structures). Conservative substitution Tables are well known in the art (see for example Creighton T E (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 1 (Example 1) were identified from the databases using BLAST™ software with the Blastp and tBlastn algorithms as filters for the first stage, and the needle (EMBOSS package) or Frame+ algorithm alignment for the second stage. Local identity (BLAST™ alignments) was defined with a very permissive cutoff—60% Identity on a span of 60% of the sequences lengths because it is used only as a filter for the global alignment stage. The default filtering of the BLAST™ package was not utilized (by setting the parameter "-F F").

In the second stage, homologs were defined based on a global identity of at least 80% to the core gene polypeptide sequence. Two distinct forms for finding the optimal global alignment for protein or nucleotide sequences were used in this application:

1. Between two proteins (following the BLASTP filter):

EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the TBLASTN filter):

GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options described hereinabove.

The query polypeptide sequences were the sequences listed in Table 1 (Example 1). The subject sequences are protein sequences identified in the database based on greater than 80% global identity to the predicted translated sequences of the query nucleotide sequences or to the polypeptide sequences. Homology was calculated as % of identity over the aligned sequences. The identified orthologous and homologous sequences having at least 80% global sequence identity to said sequences are provided in Table 2, below. These homologous genes are expected to increase plant resistance to fungal infection caused by the mentioned pathogens.

TABLE 2

Homologues (e.g., orthologues) of genes associated with plant resistance to fungal infection

| P.N. SEQ ID NO: | Hom. to Gene Name | Organism and cluster name | P.P. SEQ ID NO: | Hom. to SEQ ID NO: | % glob. Iden. | Algor. |
|---|---|---|---|---|---|---|
| 461 | LFS73 | rye\|12v1\|DRR001012.104905 | — | 630 | 93.80 | glotblastn |
| 462 | LFS73 | barley\|15v2\|AK364670_P1 | 889 | 630 | 92.50 | globlastp |
| 552 | LFS28 | sorghum\|13v2\|AW677965 | 974 | 966 | 89.90 | globlastp |
| 524 | LFS48 | foxtail_millet\|14v1\|PHY7SI016521M_P1 | 938 | 943 | 87.60 | globlastp |
| 525 | LFS48 | millet\|10v1\|EVO454PM006842_P1 | 939 | 943 | 85.20 | globlastp |
| 546 | LFS48 | rice\|15v1\|CA766103 | — | 943 | 82.05 | glotblastn |
| 547 | LAB511 | switchgrass\|12v1\|FL746481 | 951 | 965 | 83.40 | globlastp |
| 526 | LAB511 | switchgrass\|12v1\|SRR187765.483904 | — | 965 | 82.95 | glotblastn |
| 527 | LAB511 | foxtail_millet\|14v1\|XM_004960072_T1 | — | 965 | 82.53 | glotblastn |
| 548 | LAB511 | maize\|15v1\|CD970855_P1 | 973 | 965 | 82.10 | globlastp |
| 549 | LAB511 | maize\|15v1\|DY535185_P1 | 952 | 965 | 81.10 | globlastp |
| 550 | LAB511 | sorghum\|13v2\|XM_002447200 | 953 | 965 | 80.60 | globlastp |
| 551 | LAB511 | sorghum\|13v2\|CX610661 | 954 | 965 | 80.20 | globlastp |
| 241 | LFS24 | sorghum\|13v2\|BG558020 | 704 | 589 | 91.60 | globlastp |
| 242 | LFS24 | switchgrass\|12v1\|DN143477 | 705 | 589 | 84.10 | globlastp |
| 243 | LFS24 | echinochloa\|14v1\|SRR522894X143197D1_P1 | 706 | 589 | 82.80 | globlastp |
| 244 | LFS24 | foxtail_millet\|14v1\|EC612087_P1 | 707 | 589 | 81.40 | globlastp |
| 185 | LFS2 | rye\|12v1\|BE586308 | 655 | 571 | 93.00 | globlastp |
| 186 | LFS2 | wheat\|12v3\|BQ805651 | 656 | 571 | 92.70 | globlastp |
| 187 | LFS2 | rye\|12v1\|DRR001012.11364 | 657 | 571 | 92.20 | globlastp |
| 188 | LFS2 | wheat\|12v3\|BE404157 | 658 | 571 | 92.20 | globlastp |
| 521 | LFS48 | echinochloa\|14v1\|SRR522894X114688D1_T1 | — | 942 | 89.90 | glotblastn |
| 522 | LFS48 | switchgrass\|12v1\|FE603017 | 936 | 942 | 85.90 | globlastp |
| 523 | LFS48 | maize\|15v1\|CD951781_P1 | 937 | 942 | 80.50 | globlastp |
| 468 | LFS76 | rye\|12v1\|GFXFJ535238X1 | 895 | 633 | 94.80 | globlastp |
| 469 | LFS76 | wheat\|12v3\|CA679884 | 896 | 633 | 93.50 | globlastp |
| 470 | LFS76 | rye\|12v1\|DRR001012.108690 | 897 | 633 | 92.30 | globlastp |
| 471 | LFS76 | barley\|15v2\|BE413097_P1 | 898 | 633 | 92.10 | globlastp |
| 472 | LFS76 | aegilops\|16v1\|AET16V1CRP035055_P1 | 899 | 633 | 91.80 | globlastp |
| 473 | LFS76 | wheat\|12v3\|CK163601 | 900 | 633 | 90.70 | globlastp |
| 474 | LFS76 | aegilops\|16v1\|DRR001933X243680D1_P1 | 901 | 633 | 86.30 | globlastp |
| 475 | LFS76 | aegilops\|16v1\|AET16V1CRP050870_T1 | — | 633 | 85.28 | glotblastn |
| 476 | LFS76 | wheat\|12v3\|BE404901 | 902 | 633 | 83.90 | globlastp |
| 477 | LFS76 | wheat\|12v3\|BE401152 | 903 | 633 | 83.10 | globlastp |
| 478 | LFS76 | rye\|12v1\|DRR001014.575164 | — | 633 | 83.06 | glotblastn |
| 479 | LFS76 | barley\|15v2\|HV15V1CRP044213_P1 | 904 | 633 | 81.70 | globlastp |
| 480 | LFS76 | wheat\|12v3\|CA644338 | 905 | 633 | 81.40 | globlastp |
| 481 | LFS76 | brachypodium\|14v1\|GT802548_P1 | 906 | 633 | 81.20 | globlastp |
| 482 | LFS76 | aegilops\|16v1\|AET16V1CRP035057_P1 | 907 | 633 | 80.60 | globlastp |
| 483 | LFS76 | brachypodium\|14v1\|DV488684_P1 | 908 | 633 | 80.60 | globlastp |
| 484 | LFS76 | wheat\|12v3\|SRR400828X659068D1 | — | 633 | 80.32 | glotblastn |
| 350 | LFS42 | sorghum\|13v2\|BF507255 | 795 | 604 | 92.10 | globlastp |
| 351 | LFS42 | switchgrass\|12v1\|SRR187767.213464 | — | 604 | 89.06 | glotblastn |
| 352 | LFS42 | foxtail_millet\|14v1\|XM_004968983_P1 | 796 | 604 | 84.80 | globlastp |
| 353 | LFS42 | millet\|10v1\|EVO454PM066944_P1 | 797 | 604 | 83.50 | globlastp |
| 201 | LFS8 | aegilops\|16v1\|AET16V1CRP018569_P1 | 671 | 576 | 84.70 | globlastp |
| 202 | LFS8 | wheat\|12v3\|BG313747 | 671 | 576 | 84.70 | globlastp |
| 203 | LFS8 | wheat\|12v3\|AL821923 | 672 | 576 | 84.40 | globlastp |
| 204 | LFS8 | leymus\|gb166\|EG401721_P1 | 673 | 576 | 83.30 | globlastp |
| 232 | LFS16 | sorghum\|13v2\|BE595959 | 695 | 583 | 94.20 | globlastp |
| 233 | LFS16 | foxtail_millet\|14v1\|JK550380_P1 | 696 | 583 | 89.60 | globlastp |
| 234 | LFS16 | switchgrass\|12v1\|FE628035 | 697 | 583 | 89.60 | globlastp |

TABLE 2-continued

Homologues (e.g., orthologues) of genes associated with plant resistance to fungal infection

| P.N. SEQ ID NO: | Hom. to Gene Name | Organism and cluster name | P.P. SEQ ID NO: | Hom. to SEQ ID NO: | % glob. Iden. | Algor. |
|---|---|---|---|---|---|---|
| 235 | LFS16 | switchgrass\|12v1\|FE611166 | 698 | 583 | 89.10 | globlastp |
| 236 | LFS16 | rice\|15v1\|CB680836 | 699 | 583 | 82.20 | globlastp |
| 440 | LFS68 | aegilops\|16v1\|AET16V1PRD035326_P1 | 870 | 626 | 91.30 | globlastp |
| 441 | LFS68 | rye\|12v1\|BE496031 | 871 | 626 | 90.20 | globlastp |
| 442 | LFS68 | wheat\|12v3\|ERR125556X206228D1 | 872 | 626 | 90.20 | globlastp |
| 443 | LFS68 | wheat\|12v3\|BE492942 | 873 | 626 | 89.40 | globlastp |
| 444 | LFS68 | rye\|12v1\|DRR001012.590018 | 874 | 626 | 89.00 | globlastp |
| 445 | LFS68 | rye\|12v1\|DRR001012.180664 | 875 | 626 | 87.20 | globlastp |
| 446 | LFS68 | oat\|14v1\|GR366795_P1 | 876 | 626 | 85.10 | globlastp |
| 447 | LFS68 | rye\|12v1\|DRR001012.177439 | 877 | 626 | 84.00 | globlastp |
| 448 | LFS68 | barley\|15v2\|BE412789_P1 | 878 | 626 | 82.10 | globlastp |
| 449 | LFS68 | oat\|14v1\|GR356944_P1 | 879 | 626 | 80.20 | globlastp |
| 553 | LFS79 | rye\|12v1\|DRR001012.103995 | 955 | 967 | 96.40 | globlastp |
| 554 | LFS79 | rye\|12v1\|DRR001012.100386 | 956 | 967 | 96.10 | globlastp |
| 555 | LFS79 | wheat\|12v3\|BE604530 | 957 | 967 | 95.80 | globlastp |
| 556 | LFS79 | rye\|12v1\|DRR001012.158837 | 958 | 967 | 95.80 | globlastp |
| 557 | LFS79 | aegilops\|16v1\|KJ608058_P1 | 959 | 967 | 94.60 | globlastp |
| 570 | LFS79 | pseudoroegneria\|gb167\|FF344192 | 975 | 967 | 93.90 | globlastp |
| 558 | LFS79 | oat\|14v1\|GR350608_P1 | 960 | 967 | 88.30 | globlastp |
| 559 | LFS79 | oat\|14v1\|GR354682_P1 | 976 | 967 | 88.30 | globlastp |
| 560 | LFS79 | oat\|14v1\|SRR020744X192992D1_P1 | 961 | 967 | 88.30 | globlastp |
| 561 | LFS79 | oat\|14v1\|GR354701_P1 | 962 | 967 | 88.00 | globlastp |
| 562 | LFS79 | oat\|14v1\|SRR020744X93227D1_P1 | 963 | 967 | 88.00 | globlastp |
| 563 | LFS79 | oat\|14v1\|ASTE13V1K23C304615_P1 | 964 | 967 | 87.10 | globlastp |
| 564 | LFS79 | oat\|14v1\|SRR020741X245165D1_P1 | 977 | 967 | 83.40 | globlastp |
| 485 | LFS77 | wheat\|12v3\|BE420085 | — | 634 | 83.10 | glotblastn |
| 486 | LFS77 | aegilops\|16v1\|AET16V1PRD016747_T1 | — | 634 | 80.82 | glotblastn |
| 487 | LFS77 | aegilops\|16v1\|UNMK23C263100_T1 | — | 634 | 80.28 | glotblastn |
| 488 | LFS77 | rye\|12v1\|DRR001012.226432 | — | 634 | 80.00 | glotblastn |
| 335 | LFS38 | sorghum\|13v2\|CF759046 | 782 | 602 | 90.40 | globlastp |
| 336 | LFS38 | foxtail_millet\|14v1\|XM_004975720_P1 | 783 | 602 | 89.00 | globlastp |
| 337 | LFS38 | switchgrass\|12v1\|FL778360 | 784 | 602 | 87.80 | globlastp |
| 338 | LFS38 | rice\|15v1\|BI809181 | 785 | 602 | 82.30 | globlastp |
| 339 | LFS38 | brachypodium\|14v1\|GT839590_P1 | 786 | 602 | 81.60 | globlastp |
| 340 | LFS38 | rye\|12v1\|DRR001012.105662 | 787 | 602 | 81.50 | globlastp |
| 341 | LFS38 | rye\|12v1\|DRR001012.114613 | 788 | 602 | 81.30 | globlastp |
| 342 | LFS38 | wheat\|12v3\|CA716307 | 789 | 602 | 81.10 | globlastp |
| 343 | LFS38 | aegilops\|16v1\|AET16V1PRD037842_T1 | — | 602 | 80.47 | glotblastn |
| 503 | LFS43 | brachypodium\|14v1\|DV471685_P1 | 923 | 644 | 82.90 | globlastp |
| 394 | LFS51 | foxtail_millet\|14v1\|EC612578_P1 | 831 | 612 | 89.90 | globlastp |
| 395 | LFS51 | switchgrass\|12v1\|SRR187767.167080 | 832 | 612 | 86.40 | globlastp |
| 396 | LFS51 | rice\|15v1\|AU091275 | 833 | 612 | 85.40 | globlastp |
| 397 | LFS51 | aegilops\|16v1\|AET16V1CRP003692_P1 | 834 | 612 | 83.60 | globlastp |
| 398 | LFS51 | brachypodium\|14v1\|DV485657_P1 | 835 | 612 | 83.50 | globlastp |
| 399 | LFS51 | rye\|12v1\|DRR001012.107038 | 836 | 612 | 83.50 | globlastp |
| 400 | LFS51 | switchgrass\|12v1\|DN142155 | — | 612 | 82.36 | glotblastn |
| 401 | LFS51 | brachypodium\|14v1\|GT770007_T1 | — | 612 | 81.35 | glotblastn |
| 402 | LFS51 | switchgrass\|12v1\|SRR187765.582124 | 837 | 612 | 81.20 | globlastp |
| 403 | LFS51 | foxtail_millet\|14v1\|XM_004972058_P1 | 838 | 612 | 81.00 | globlastp |
| 404 | LFS51 | foxtail_millet\|14v1\|XM_004972057_P1 | 839 | 612 | 80.70 | globlastp |
| 283 | LFS35 | sorghum\|13v2\|BE126163 | 740 | 599 | 92.20 | globlastp |
| 284 | LFS35 | foxtail_millet\|14v1\|XM_004984084_P1 | 741 | 599 | 81.80 | globlastp |
| 285 | LFS35 | maize\|15v1\|CO528347_P1 | 742 | 599 | 80.30 | globlastp |
| 502 | LFS38 | switchgrass\|12v1\|SRR187765.292239 | 922 | 643 | 88.50 | globlastp |
| 354 | LFS43 | sorghum\|13v2\|AI723967 | 798 | 605 | 93.40 | globlastp |
| 355 | LFS43 | switchgrass\|12v1\|SRR187765.34871 | 799 | 605 | 89.70 | globlastp |
| 356 | LFS43 | foxtail_millet\|14v1\|PHY7SI016880M_P1 | 800 | 605 | 88.40 | globlastp |
| 357 | LFS43 | barley\|15v2\|BQ458589_P1 | 801 | 605 | 85.10 | globlastp |
| 358 | LFS43 | aegilops\|16v1\|AET16V1CRP016465_P1 | 802 | 605 | 85.00 | globlastp |
| 359 | LFS43 | rice\|15v1\|AU058037 | 803 | 605 | 84.60 | globlastp |
| 360 | LFS43 | rice\|15v1\|CI107273 | — | 605 | 84.30 | glotblastn |
| 361 | LFS43 | maize\|15v1\|EXP1208S11328X013181941D1_T1 | — | 605 | 83.62 | glotblastn |
| 463 | LFS74 | rye\|12v1\|DRR001012.138028 | 890 | 631 | 94.50 | globlastp |
| 464 | LFS74 | rye\|12v1\|DRR001012.10513 | 891 | 631 | 94.40 | globlastp |
| 465 | LFS74 | rye\|12v1\|DRR001014.575857 | 892 | 631 | 94.40 | globlastp |
| 466 | LFS74 | barley\|15v2\|BE413202_P1 | 893 | 631 | 90.00 | globlastp |
| 460 | LFS72 | barley\|15v2\|BI954682_P1 | 888 | 629 | 88.80 | globlastp |
| 213 | LFS10 | rye\|12v1\|DRR001012.29282 | — | 578 | 90.97 | glotblastn |
| 214 | LFS10 | wheat\|12v3\|BQ805548 | 681 | 578 | 90.70 | globlastp |
| 215 | LFS10 | aegilops\|16v1\|AET16V1CRP002333_P1 | 682 | 578 | 89.10 | globlastp |
| 216 | LFS10 | switchgrass\|12v1\|FL865876 | 683 | 578 | 86.70 | globlastp |
| 217 | LFS10 | switchgrass\|12v1\|FL865875 | 684 | 578 | 86.40 | globlastp |
| 218 | LFS10 | sorghum\|13v2\|CB926473 | 685 | 578 | 86.20 | globlastp |
| 219 | LFS10 | foxtail_millet\|14v1\|XM_004956897_P1 | 686 | 578 | 86.10 | globlastp |

TABLE 2-continued

Homologues (e.g., orthologues) of genes associated with plant resistance to fungal infection

| P.N. SEQ ID NO: | Hom. to Gene Name | Organism and cluster name | P.P. SEQ ID NO: | Hom. to SEQ ID NO: | % glob. Iden. | Algor. |
|---|---|---|---|---|---|---|
| 220 | LFS10 | switchgrass\|12v1\|FL854196 | 687 | 578 | 86.00 | globlastp |
| 221 | LFS10 | maize\|15v1\|BI478869_T1 | — | 578 | 84.83 | glotblastn |
| 222 | LFS10 | maize\|15v1\|BM379500_T1 | — | 578 | 84.83 | glotblastn |
| 223 | LFS10 | brachypodium\|14v1\|DV486901_P1 | 688 | 578 | 80.50 | globlastp |
| 272 | LFS32 | sorghum\|13v2\|CD210737 | — | 596 | 80.29 | glotblastn |
| 189 | LFS3 | barley\|15v2\|BE422284XX2_P1 | 659 | 572 | 92.60 | globlastp |
| 190 | LFS3 | aegilops\|16v1\|AET16V1CRP048397_P1 | 660 | 572 | 90.60 | globlastp |
| 191 | LFS3 | wheat\|12v3\|BQ838562 | 661 | 572 | 87.90 | globlastp |
| 192 | LFS3 | aegilops\|16v1\|AET16V1CRP048396_P1 | 662 | 572 | 86.20 | globlastp |
| 193 | LFS3 | leymus\|gb166\|EG374767_P1 | 663 | 572 | 85.20 | globlastp |
| 427 | LFS62 | maize\|15v1\|DW846968_P1 | 860 | 622 | 91.80 | globlastp |
| 428 | LFS62 | maize\|15v1\|BM266980_P1 | 861 | 622 | 87.50 | globlastp |
| 429 | LFS62 | maize\|15v1\|EE332074_T1 | — | 622 | 83.74 | glotblastn |
| 430 | LFS62 | foxtail_millet\|14v1\|XM_004975122_P1 | 862 | 622 | 83.70 | globlastp |
| 431 | LFS62 | maize\|15v1\|DN230402_P1 | 863 | 622 | 83.00 | globlastp |
| 432 | LFS62 | switchgrass\|12v1\|SRR187767.674223 | — | 622 | 81.72 | glotblastn |
| 435 | LFS67 | rye\|12v1\|DRR001012.105129 | 866 | 625 | 96.00 | globlastp |
| 436 | LFS67 | barley\|15v2\|AJ475921_P1 | 867 | 625 | 92.00 | globlastp |
| 437 | LFS67 | aegilops\|16v1\|AET16V1CRP041250_P1 | 868 | 625 | 84.80 | globlastp |
| 438 | LFS67 | brachypodium\|14v1\|XM_003579803_P1 | 869 | 625 | 83.70 | globlastp |
| 439 | LFS67 | oat\|14v1\|GR362039_T1 | — | 625 | 80.18 | glotblastn |
| 237 | LFS54 | foxtail_millet\|14v1\|XM_004985600_P1 | 700 | 615 | 87.30 | globlastp |
| 238 | LFS54 | switchgrass\|12v1\|FL909881 | 701 | 615 | 85.30 | globlastp |
| 240 | LFS54 | millet\|10v1\|PMSLX0056215D1_P1 | 703 | 615 | 83.90 | globlastp |
| 239 | LFS54 | rice\|15v1\|AU056672 | 702 | 615 | 83.90 | globlastp |
| 410 | LFS54 | barley\|15v2\|BF623877_P1 | 844 | 615 | 81.60 | globlastp |
| 411 | LFS54 | wheat\|12v3\|BE414911 | 845 | 615 | 81.10 | globlastp |
| 412 | LFS54 | brachypodium\|14v1\|GT817337_P1 | 846 | 615 | 80.80 | globlastp |
| 413 | LFS54 | oat\|14v1\|SRR020741X40277D1_P1 | 847 | 615 | 80.70 | globlastp |
| 414 | LFS54 | rye\|12v1\|DRR001012.112989 | 848 | 615 | 80.60 | globlastp |
| 224 | LFS11 | sugarcane\|10v1\|BQ532991 | 689 | 579 | 94.30 | globlastp |
| 225 | LFS11 | sorghum\|13v2\|AW672410 | 690 | 579 | 93.70 | globlastp |
| 226 | LFS11 | echinochloa\|14v1\|SRR522894X122343D1_P1 | 691 | 579 | 90.40 | globlastp |
| 227 | LFS11 | echinochloa\|14v1\|SRR522894X156577D1_P1 | 691 | 579 | 90.40 | globlastp |
| 228 | LFS11 | echinochloa\|14v1\|SRR522894X21605D1_P1 | 692 | 579 | 89.50 | globlastp |
| 229 | LFS11 | echinochloa\|14v1\|SRR522894X107346D1_P1 | 693 | 579 | 81.50 | globlastp |
| 433 | LFS65 | sorghum\|13v2\|EH410699 | 864 | 623 | 82.60 | globlastp |
| 512 | LFS68 | aegilops\|16v1\|AET16V1PRD035325_P1 | 649 | 649 | 100.00 | globlastp |
| 514 | LFS75 | rye\|12v1\|DRR001012.123365 | 931 | 653 | 94.10 | globlastp |
| 515 | LFS75 | rye\|12v1\|DRR001012.210738 | 932 | 653 | 92.50 | globlastp |
| 516 | LFS75 | barley\|15v2\|BI946793_P1 | 933 | 653 | 90.90 | globlastp |
| 517 | LFS75 | oat\|14v1\|GR354588_T1 | — | 653 | 80.86 | glotblastn |
| 489 | LFS78 | maize\|15v1\|UNMK35C13524597_P1 | 909 | 635 | 90.10 | globlastp |
| 405 | LFS52 | maize\|15v1\|AW067380_P1 | 840 | 613 | 88.90 | globlastp |
| 406 | LFS52 | maize\|15v1\|EXP1208S11326X010812552D1_T1 | — | 613 | 88.63 | glotblastn |
| 407 | LFS52 | foxtail_millet\|14v1\|XM_004958211_P1 | 841 | 613 | 83.00 | globlastp |
| 415 | LFS55 | switchgrass\|12v1\|FE601737 | 849 | 616 | 84.40 | globlastp |
| 456 | LFS71 | aegilops\|16v1\|BF291509_P1 | 885 | 628 | 97.30 | globlastp |
| 457 | LFS71 | rye\|12v1\|DRR001012.103095 | 886 | 628 | 90.90 | globlastp |
| 458 | LFS71 | barley\|15v2\|CA009878_T1 | — | 628 | 90.87 | glotblastn |
| 459 | LFS71 | brachypodium\|14v1\|DV475338_P1 | 887 | 628 | 81.10 | globlastp |
| 306 | LFS37 | sorghum\|13v2\|AI724117 | 755 | 601 | 96.50 | globlastp |
| 307 | LFS37 | foxtail_millet\|14v1\|EC613710_P1 | 756 | 601 | 94.90 | globlastp |
| 308 | LFS37 | switchgrass\|12v1\|FE621952 | 757 | 601 | 94.40 | globlastp |
| 309 | LFS37 | switchgrass\|12v1\|DT948924 | 758 | 601 | 94.00 | globlastp |
| 310 | LFS37 | echinochloa\|14v1\|SRR522894X100700D1_P1 | 759 | 601 | 93.90 | globlastp |
| 311 | LFS37 | millet\|10v1\|CD724661_P1 | 760 | 601 | 93.70 | globlastp |
| 312 | LFS37 | brachypodium\|14v1\|DV486568_P1 | 761 | 601 | 90.60 | globlastp |
| 313 | LFS37 | rye\|12v1\|DRR001012.105403 | — | 601 | 89.31 | glotblastn |
| 314 | LFS37 | wheat\|12v3\|BI750976 | 762 | 601 | 89.30 | globlastp |
| 315 | LFS37 | rye\|12v1\|DRR001012.107445 | — | 601 | 89.23 | glotblastn |
| 316 | LFS37 | oat\|14v1\|SRR020741X11812D1_P1 | 763 | 601 | 89.20 | globlastp |
| 317 | LFS37 | aegilops\|16v1\|AET16V1PRD016989_P1 | 764 | 601 | 89.10 | globlastp |
| 318 | LFS37 | foxtail_millet\|14v1\|XM_004973775_P1 | 765 | 601 | 89.10 | globlastp |
| 319 | LFS37 | rice\|15v1\|CF992373 | 766 | 601 | 89.00 | globlastp |
| 320 | LFS37 | sorghum\|13v2\|CF480199 | 767 | 601 | 87.40 | globlastp |
| 321 | LFS37 | sugarcane\|10v1\|CA072412 | 768 | 601 | 87.10 | globlastp |
| 322 | LFS37 | maize\|15v1\|BE640562_P1 | 769 | 601 | 84.50 | globlastp |
| 323 | LFS37 | maize\|15v1\|EC591027_P1 | 770 | 601 | 84.30 | globlastp |
| 324 | LFS37 | wheat\|12v3\|CA666875 | 771 | 601 | 84.10 | globlastp |
| 325 | LFS37 | rye\|12v1\|DRR001012.148038 | 772 | 601 | 84.00 | globlastp |
| 326 | LFS37 | coconut\|14v1\|COCOS14V1K19C1074024_P1 | 773 | 601 | 81.40 | globlastp |
| 327 | LFS37 | coconut\|14v1\|COCOS14V1K19C1505184_P1 | 774 | 601 | 81.30 | globlastp |
| 328 | LFS37 | chelidonium\|11v1\|SRR084752X101619_P1 | 775 | 601 | 81.00 | globlastp |

TABLE 2-continued

Homologues (e.g., orthologues) of genes associated with plant resistance to fungal infection

| P.N. SEQ ID NO: | Hom. to Gene Name | Organism and cluster name | P.P. SEQ ID NO: | Hom. to SEQ ID NO: | % glob. Iden. | Algor. |
|---|---|---|---|---|---|---|
| 329 | LFS37 | pineapple\|14v1\|DT337633_P1 | 776 | 601 | 81.00 | globlastp |
| 330 | LFS37 | aquilegia\|10v2\|DR946530_P1 | 777 | 601 | 80.70 | globlastp |
| 331 | LFS37 | wheat\|12v3\|BF473779 | 778 | 601 | 80.40 | globlastp |
| 332 | LFS37 | poppy\|11v1\|SRR030259.105826_P1 | 779 | 601 | 80.30 | globlastp |
| 333 | LFS37 | amborella\|12v3\|CK758459_P1 | 780 | 601 | 80.20 | globlastp |
| 334 | LFS37 | banana\|14v1\|MAGEN2012001392_P1 | 781 | 601 | 80.00 | globlastp |
| 450 | LFS70 | rye\|12v1\|DRR001012.120897 | 627 | 627 | 100.00 | globlastp |
| 451 | LFS70 | barley\|15v2\|BF623292_P1 | 880 | 627 | 97.70 | globlastp |
| 452 | LFS70 | rye\|12v1\|DRR001017.1051299 | 881 | 627 | 92.60 | globlastp |
| 453 | LFS70 | wheat\|12v3\|BQ483330 | 882 | 627 | 89.80 | globlastp |
| 454 | LFS70 | barley\|15v2\|AK370420_P1 | 883 | 627 | 89.20 | globlastp |
| 455 | LFS70 | aegilops\|16v1\|AET16V1CRP000111_P1 | 884 | 627 | 81.80 | globlastp |
| 417 | LFS58 | sugarcane\|10v1\|CA135276 | 851 | 618 | 86.40 | globlastp |
| 277 | LFS34 | maize\|15v1\|DW907845_T1 | — | 598 | 99.70 | glotblastn |
| 278 | LFS34 | maize\|15v1\|CD941187_P1 | 737 | 598 | 85.50 | globlastp |
| 279 | LFS34 | sorghum\|13v2\|AW677361 | 738 | 598 | 83.20 | globlastp |
| 280 | LFS34 | sugarcane\|10v1\|CA098461 | — | 598 | 80.72 | glotblastn |
| 281 | LFS34 | switchgrass\|12v1\|FE638209 | — | 598 | 80.71 | glotblastn |
| 282 | LFS34 | millet\|10v1\|EVO454PM056569_P1 | 739 | 598 | 80.70 | globlastp |
| 567 | LFS22 | sugarcane\|10v1\|BQ533886 | 969 | 940 | 94.90 | globlastp |
| 542 | LFS22 | sorghum\|13v2\|BE355836 | 970 | 940 | 93.60 | globlastp |
| 543 | LFS22 | foxtail_millet\|14v1\|EC612997_P1 | 948 | 940 | 84.10 | globlastp |
| 520 | LFS22 | echinochloa\|14v1\|SRR522894X129754D1_T1 | — | 940 | 84.08 | glotblastn |
| 544 | LFS22 | switchgrass\|12v1\|FL773555 | 949 | 940 | 82.20 | globlastp |
| 545 | LFS22 | switchgrass\|12v1\|SRR187765.131852 | 950 | 940 | 80.40 | globlastp |
| 513 | LFS72 | aegilops\|16v1\|EMT20096_P1 | 930 | 651 | 86.20 | globlastp |
| 237 | LFS23 | foxtail_millet\|14v1\|XM_004985600_P1 | 700 | 588 | 84.60 | globlastp |
| 238 | LFS23 | switchgrass\|12v1\|FL909881 | 701 | 588 | 83.90 | globlastp |
| 239 | LFS23 | rice\|15v1\|AU056672 | 702 | 588 | 81.00 | globlastp |
| 240 | LFS23 | millet\|10v1\|PMSLX0056215D1_P1 | 703 | 588 | 80.40 | globlastp |
| 434 | LFS66 | sugarcane\|10v1\|CA105932 | 865 | 624 | 83.20 | globlastp |
| 538 | LFS13 | maize\|15v1\|BM380262_P1 | 944 | 580 | 96.70 | globlastp |
| 539 | LFS13 | sugarcane\|10v1\|CA204117 | 945 | 580 | 86.40 | globlastp |
| 540 | LFS13 | sugarcane\|10v1\|CA138499 | 946 | 580 | 83.50 | globlastp |
| 230 | LFS13 | maize\|15v1\|BQ547702_T1 | — | 580 | 81.91 | glotblastn |
| 231 | LFS13 | maize\|15v1\|NM_001154979_P1 | 694 | 580 | 81.90 | globlastp |
| 541 | LFS13 | sugarcane\|10v1\|CA129798 | 947 | 580 | 81.80 | globlastp |
| 286 | LFS36 | maize\|15v1\|BM736190_P1 | 743 | 600 | 99.70 | globlastp |
| 287 | LFS36 | maize\|15v1\|DW245917_P1 | 744 | 600 | 99.40 | globlastp |
| 288 | LFS36 | maize\|15v1\|DT535900_T1 | — | 600 | 93.79 | glotblastn |
| 289 | LFS36 | maize\|15v1\|BG840138_T1 | — | 600 | 92.63 | glotblastn |
| 290 | LFS36 | maize\|15v1\|DW799418_T1 | — | 600 | 89.74 | glotblastn |
| 291 | LFS36 | sorghum\|13v2\|CB927729 | 745 | 600 | 89.40 | globlastp |
| 292 | LFS36 | sorghum\|13v2\|CB927628 | 746 | 600 | 87.90 | globlastp |
| 293 | LFS36 | sorghum\|13v2\|AW283259 | — | 600 | 87.57 | glotblastn |
| 294 | LFS36 | maize\|15v1\|CO466858_P1 | 747 | 600 | 87.00 | globlastp |
| 295 | LFS36 | maize\|15v1\|DQ246089_T1 | — | 600 | 86.73 | glotblastn |
| 296 | LFS36 | sugarcane\|10v1\|CA093054 | 748 | 600 | 86.20 | globlastp |
| 297 | LFS36 | maize\|15v1\|EXP1208S11311X043816967D1_T1 | — | 600 | 85.84 | glotblastn |
| 298 | LFS36 | foxtail_millet\|14v1\|EC612925_P1 | 749 | 600 | 84.30 | globlastp |
| 299 | LFS36 | foxtail_millet\|14v1\|XM_004960354_P1 | 750 | 600 | 82.90 | globlastp |
| 300 | LFS36 | maize\|15v1\|BM952659_T1 | — | 600 | 81.71 | glotblastn |
| 301 | LFS36 | sorghum\|13v2\|XM_002439189 | 751 | 600 | 81.70 | globlastp |
| 302 | LFS36 | echinochloa\|14v1\|SRR522894X252171D1_P1 | 752 | 600 | 81.40 | globlastp |
| 303 | LFS36 | echinochloa\|14v1\|ECHC14V1K19C85769_P1 | 753 | 600 | 80.50 | globlastp |
| 304 | LFS36 | switchgrass\|12v1\|FL915672 | 754 | 600 | 80.20 | globlastp |
| 305 | LFS36 | maize\|15v1\|EXP1208S11311X042935124D1_T1 | — | 600 | 80.12 | glotblastn |
| 421 | LFS61 | sugarcane\|10v1\|CA108591 | 854 | 621 | 96.30 | globlastp |
| 422 | LFS61 | maize\|15v1\|AI966920_P1 | 855 | 621 | 90.70 | globlastp |
| 423 | LFS61 | wheat\|12v3\|CA625253 | 856 | 621 | 89.80 | globlastp |
| 424 | LFS61 | foxtail_millet\|14v1\|XM_004952640_P1 | 857 | 621 | 87.20 | globlastp |
| 425 | LFS61 | switchgrass\|12v1\|SRR187765.111739 | 858 | 621 | 87.20 | globlastp |
| 426 | LFS61 | switchgrass\|12v1\|FL891452 | 859 | 621 | 86.50 | globlastp |
| 344 | LFS39 | foxtail_millet\|14v1\|JK567619_P1 | 790 | 603 | 88.60 | globlastp |
| 345 | LFS39 | switchgrass\|12v1\|HO339160 | 791 | 603 | 87.30 | globlastp |
| 346 | LFS39 | sorghum\|13v2\|XM_002440892 | 792 | 603 | 86.70 | globlastp |
| 347 | LFS39 | switchgrass\|12v1\|GD050070 | — | 603 | 84.31 | glotblastn |
| 348 | LFS39 | aegilops\|16v1\|AET16V1CRP032906_P1 | 793 | 603 | 80.20 | globlastp |
| 349 | LFS39 | wheat\|12v3\|EB512032 | 794 | 603 | 80.20 | globlastp |
| 362 | LFS44 | sorghum\|13v2\|AW672390 | 804 | 606 | 90.40 | globlastp |
| 363 | LFS44 | echinochloa\|14v1\|SRR522894X161177D1_P1 | 805 | 606 | 88.40 | globlastp |
| 364 | LFS44 | foxtail_millet\|14v1\|XM_004984688_P1 | 806 | 606 | 85.40 | globlastp |
| 365 | LFS44 | sugarcane\|10v1\|CA110654 | 807 | 606 | 84.70 | globlastp |
| 366 | LFS44 | switchgrass\|12v1\|DN144469 | 808 | 606 | 83.00 | globlastp |

TABLE 2-continued

Homologues (e.g., orthologues) of genes associated with plant resistance to fungal infection

| P.N. SEQ ID NO: | Hom. to Gene Name | Organism and cluster name | P.P. SEQ ID NO: | Hom. to SEQ ID NO: | % glob. Iden. | Algor. |
|---|---|---|---|---|---|---|
| 245 | LFS25 | foxtail_millet\|14v1\|JK594303_P1 | 708 | 590 | 95.10 | globlastp |
| 246 | LFS25 | maize\|15v1\|BG321301_P1 | 709 | 590 | 94.70 | globlastp |
| 247 | LFS25 | switchgrass\|12v1\|FE608907 | 710 | 590 | 94.50 | globlastp |
| 248 | LFS25 | sorghum\|13v2\|XM_002458092 | 711 | 590 | 94.20 | globlastp |
| 249 | LFS25 | switchgrass\|12v1\|FL814664 | 712 | 590 | 94.20 | globlastp |
| 250 | LFS25 | sorghum\|13v2\|EH410139 | 713 | 590 | 93.80 | globlastp |
| 251 | LFS25 | sorghum\|13v2\|AW678088 | 714 | 590 | 91.30 | globlastp |
| 252 | LFS25 | switchgrass\|12v1\|FL714712 | 715 | 590 | 89.30 | globlastp |
| 253 | LFS25 | foxtail_millet\|14v1\|XM_004969068_P1 | 716 | 590 | 88.50 | globlastp |
| 254 | LFS25 | brachypodium\|14v1\|XM_003569281_P1 | 717 | 590 | 88.20 | globlastp |
| 255 | LFS25 | aegilops\|16v1\|AET16V1PRD033403_P1 | 718 | 590 | 87.40 | globlastp |
| 256 | LFS25 | rice\|15v1\|AF093586 | 719 | 590 | 87.30 | globlastp |
| 257 | LFS25 | foxtail_millet\|14v1\|XM_004969066_P1 | 720 | 590 | 82.90 | globlastp |
| 258 | LFS25 | switchgrass\|12v1\|FE620452 | 721 | 590 | 81.90 | globlastp |
| 259 | LFS25 | rye\|12v1\|DRR001012.108478 | — | 590 | 81.86 | glotblastn |
| 260 | LFS25 | rice\|15v1\|GFXBK001016X1 | 722 | 590 | 81.80 | globlastp |
| 261 | LFS25 | sorghum\|13v2\|XM_002458090 | 723 | 590 | 81.80 | globlastp |
| 262 | LFS25 | foxtail_millet\|14v1\|XM_004956311_P1 | 724 | 590 | 81.70 | globlastp |
| 263 | LFS25 | sorghum\|13v2\|XM_002462342 | 725 | 590 | 81.70 | globlastp |
| 264 | LFS25 | switchgrass\|12v1\|FL990386 | 726 | 590 | 81.70 | globlastp |
| 265 | LFS25 | sorghum\|13v2\|XM_002458088 | 727 | 590 | 80.00 | globlastp |
| 382 | LFS50 | foxtail_millet\|14v1\|XM_004953911_P1 | 821 | 611 | 92.20 | globlastp |
| 383 | LFS50 | maize\|15v1\|DN224357_P1 | 822 | 611 | 91.90 | globlastp |
| 384 | LFS50 | switchgrass\|12v1\|DN142643 | 823 | 611 | 90.40 | globlastp |
| 385 | LFS50 | maize\|15v1\|CD219163_T1 | — | 611 | 90.36 | glotblastn |
| 386 | LFS50 | switchgrass\|12v1\|DN151772 | 824 | 611 | 89.80 | globlastp |
| 387 | LFS50 | switchgrass\|12v1\|SRR187765.504644 | 825 | 611 | 89.20 | globlastp |
| 388 | LFS50 | millet\|10v1\|PMSLX0006085D1_P1 | 826 | 611 | 84.80 | globlastp |
| 389 | LFS50 | rice\|15v1\|CB648865 | 827 | 611 | 82.80 | globlastp |
| 390 | LFS50 | wheat\|12v3\|CA628023 | 828 | 611 | 82.30 | globlastp |
| 391 | LFS50 | lolium\|13v1\|LOLR13V11032789_P1 | 829 | 611 | 81.70 | globlastp |
| 392 | LFS50 | rice\|15v1\|OS15V1CRP020043 | — | 611 | 81.35 | glotblastn |
| 393 | LFS50 | wheat\|12v3\|AL824774 | 830 | 611 | 81.10 | globlastp |
| 505 | LFS55 | sorghum\|13v2\|CB926137 | 924 | 647 | 91.40 | globlastp |
| 506 | LFS55 | maize\|15v1\|BE640439_T1 | — | 647 | 89.02 | glotblastn |
| 507 | LFS55 | sorghum\|13v2\|BE357034 | 925 | 647 | 87.80 | globlastp |
| 508 | LFS55 | maize\|15v1\|BM500052_P1 | 926 | 647 | 85.00 | globlastp |
| 509 | LFS55 | switchgrass\|12v1\|FL768899 | 927 | 647 | 84.50 | globlastp |
| 510 | LFS55 | millet\|10v1\|EVO454PM067027_P1 | 928 | 647 | 84.40 | globlastp |
| 511 | LFS55 | foxtail_millet\|14v1\|XM_004969217_P1 | 929 | 647 | 83.90 | globlastp |
| 518 | LFS78 | rye\|12v1\|DRR001012.101539 | 934 | 654 | 86.40 | globlastp |
| 519 | LFS78 | rye\|12v1\|DRR001012.104618 | 935 | 654 | 85.20 | globlastp |
| 408 | LFS53 | maize\|15v1\|AW927635_P1 | 842 | 614 | 91.20 | globlastp |
| 409 | LFS53 | foxtail_millet\|14v1\|XM_004968860_P1 | 843 | 614 | 81.00 | globlastp |
| 499 | LFS18 | sorghum\|13v2\|AI723795 | 919 | 639 | 88.20 | globlastp |
| 500 | LFS18 | maize\|15v1\|AI964600_P1 | 920 | 639 | 86.60 | globlastp |
| 501 | LFS18 | sugarcane\|10v1\|BQ533917 | 921 | 639 | 86.60 | globlastp |
| 267 | LFS30 | maize\|15v1\|DV530033_T1 | — | 594 | 99.71 | glotblastn |
| 268 | LFS30 | sorghum\|13v2\|CB925282 | 729 | 594 | 86.10 | globlastp |
| 269 | LFS30 | foxtail_millet\|14v1\|XM_004981433_P1 | 730 | 594 | 81.40 | globlastp |
| 418 | LFS59 | maize\|15v1\|CD953366_T1 | — | 619 | 91.57 | glotblastn |
| 419 | LFS59 | foxtail_millet\|14v1\|JK563489_P1 | 852 | 619 | 88.00 | globlastp |
| 420 | LFS60 | sugarcane\|10v1\|CA103858 | 853 | 620 | 87.70 | globlastp |
| 467 | LFS75 | lolium\|13v1\|SRR029311X3297_P1 | 894 | 632 | 80.30 | globlastp |
| 194 | LFS4 | rye\|12v1\|DRR001012.127695 | 664 | 573 | 90.90 | globlastp |
| 195 | LFS4 | wheat\|12v3\|BQ744116 | 665 | 573 | 89.70 | globlastp |
| 196 | LFS4 | rye\|12v1\|DRR001012.1573 | 666 | 573 | 87.20 | globlastp |
| 416 | LFS57 | maize\|15v1\|CA452413_P1 | 850 | 617 | 81.50 | globlastp |
| 504 | LFS52 | switchgrass\|12v1\|FL862416 | — | 646 | 83.43 | glotblastn |
| 490 | LFS80 | sorghum\|13v2\|BE362342 | 910 | 636 | 93.80 | globlastp |
| 491 | LFS80 | foxtail_millet\|14v1\|XM_004959448_P1 | 911 | 636 | 90.40 | globlastp |
| 492 | LFS80 | switchgrass\|12v1\|FL911281 | 912 | 636 | 90.30 | globlastp |
| 493 | LFS80 | switchgrass\|12v1\|SRR187765.575969 | 913 | 636 | 88.90 | globlastp |
| 494 | LFS80 | rice\|15v1\|BE040794 | 914 | 636 | 86.30 | globlastp |
| 495 | LFS80 | wheat\|12v3\|BM140327 | 915 | 636 | 83.90 | globlastp |
| 496 | LFS80 | aegilops\|16v1\|AET16V1CRP037285_P1 | 916 | 636 | 83.60 | globlastp |
| 497 | LFS80 | rye\|12v1\|DRR001012.105429 | 917 | 636 | 83.10 | globlastp |
| 498 | LFS80 | lolium\|13v1\|SRR029311X14838_P1 | 918 | 636 | 82.00 | globlastp |
| 205 | LFS9 | wheat\|12v3\|CK194246 | 674 | 577 | 92.80 | globlastp |
| 206 | LFS9 | wheat\|12v3\|CK196678 | 675 | 577 | 92.20 | globlastp |
| 207 | LFS9 | rye\|12v1\|DRR001012.113740 | 676 | 577 | 91.70 | globlastp |
| 208 | LFS9 | rye\|12v1\|DRR001012.112962 | 677 | 577 | 91.10 | globlastp |
| 209 | LFS9 | rye\|12v1\|DRR001012.12658 | 678 | 577 | 90.70 | globlastp |
| 210 | LFS9 | aegilops\|16v1\|AET16V1CRP037184_P1 | 679 | 577 | 90.10 | globlastp |

TABLE 2-continued

Homologues (e.g., orthologues) of genes associated with plant resistance to fungal infection

<table>
<tr><th>P.N. SEQ ID NO:</th><th>Hom. to Gene Name</th><th>Organism and cluster name</th><th>P.P. SEQ ID NO:</th><th>Hom. to SEQ ID NO:</th><th>% glob. Iden.</th><th>Algor.</th></tr>
<tr><td>211</td><td>LFS9</td><td>oat|14v1|GR354580_P1</td><td>680</td><td>577</td><td>81.50</td><td>globlastp</td></tr>
<tr><td>212</td><td>LFS9</td><td>aegilops|16v1|EMT12236_T1</td><td>—</td><td>577</td><td>81.21</td><td>glotblastn</td></tr>
<tr><td>368</td><td>LFS46</td><td>foxtail_millet|14v1|XM_004954125_P1</td><td>810</td><td>608</td><td>96.00</td><td>globlastp</td></tr>
<tr><td>369</td><td>LFS46</td><td>switchgrass|12v1|FE620269</td><td>811</td><td>608</td><td>95.30</td><td>globlastp</td></tr>
<tr><td>370</td><td>LFS46</td><td>switchgrass|12v1|DN147093</td><td>812</td><td>608</td><td>94.80</td><td>globlastp</td></tr>
<tr><td>371</td><td>LFS46</td><td>foxtail_millet|14v1|PHY7SI013282M_P1</td><td>813</td><td>608</td><td>93.90</td><td>globlastp</td></tr>
<tr><td>372</td><td>LFS46</td><td>rice|15v1|BE607351</td><td>814</td><td>608</td><td>90.00</td><td>globlastp</td></tr>
<tr><td>373</td><td>LFS46</td><td>brachypodium|14v1|DV483650_P1</td><td>815</td><td>608</td><td>89.10</td><td>globlastp</td></tr>
<tr><td>374</td><td>LFS46</td><td>wheat|12v3|BE401157</td><td>—</td><td>608</td><td>88.59</td><td>glotblastn</td></tr>
<tr><td>375</td><td>LFS46</td><td>rye|12v1|DRR001012.141059</td><td>—</td><td>608</td><td>88.35</td><td>glotblastn</td></tr>
<tr><td>376</td><td>LFS46</td><td>rye|12v1|DRR001012.101790</td><td>816</td><td>608</td><td>88.30</td><td>globlastp</td></tr>
<tr><td>377</td><td>LFS46</td><td>rye|12v1|DRR001012.10184</td><td>—</td><td>608</td><td>88.00</td><td>glotblastn</td></tr>
<tr><td>378</td><td>LFS46</td><td>rye|12v1|DRR001012.100771</td><td>817</td><td>608</td><td>87.90</td><td>globlastp</td></tr>
<tr><td>379</td><td>LFS46</td><td>maize|15v1|CB239912_P1</td><td>818</td><td>608</td><td>87.10</td><td>globlastp</td></tr>
<tr><td>380</td><td>LFS46</td><td>rye|12v1|DRR001012.130964</td><td>819</td><td>608</td><td>85.30</td><td>globlastp</td></tr>
<tr><td>381</td><td>LFS46</td><td>maize|15v1|AW787244_P1</td><td>820</td><td>608</td><td>83.20</td><td>globlastp</td></tr>
<tr><td>367</td><td>LFS45</td><td>brachypodium|14v1|GT774653_P1</td><td>809</td><td>607</td><td>81.00</td><td>globlastp</td></tr>
<tr><td>197</td><td>LFS6</td><td>aegilops|16v1|AET16V1PRD000339_P1</td><td>667</td><td>574</td><td>90.10</td><td>globlastp</td></tr>
<tr><td>198</td><td>LFS6</td><td>wheat|12v3|BE489177</td><td>668</td><td>574</td><td>84.10</td><td>globlastp</td></tr>
<tr><td>199</td><td>LFS6</td><td>rye|12v1|DRR001012.104995</td><td>669</td><td>574</td><td>83.70</td><td>globlastp</td></tr>
<tr><td>200</td><td>LFS6</td><td>wheat|12v3|BE470963</td><td>670</td><td>574</td><td>83.30</td><td>globlastp</td></tr>
<tr><td>273</td><td>LFS33</td><td>maize|15v1|AI948033_P1</td><td>733</td><td>597</td><td>97.90</td><td>globlastp</td></tr>
<tr><td>274</td><td>LFS33</td><td>maize|15v1|BM501024_P1</td><td>734</td><td>597</td><td>88.70</td><td>globlastp</td></tr>
<tr><td>275</td><td>LFS33</td><td>maize|15v1|SRR014549X18495_P1</td><td>735</td><td>597</td><td>82.70</td><td>globlastp</td></tr>
<tr><td>276</td><td>LFS33</td><td>maize|15v1|BG841362_P1</td><td>736</td><td>597</td><td>81.20</td><td>globlastp</td></tr>
<tr><td>266</td><td>LFS29</td><td>maize|15v1|CF630397_P1</td><td>728</td><td>593</td><td>94.10</td><td>globlastp</td></tr>
<tr><td>270</td><td>LFS31</td><td>sorghum|13v2|BE360360</td><td>731</td><td>595</td><td>82.50</td><td>globlastp</td></tr>
<tr><td>271</td><td>LFS31</td><td>foxtail_millet|14v1|XM_004961370_P1</td><td>732</td><td>595</td><td>80.70</td><td>globlastp</td></tr>
<tr><td>568</td><td>LFS40</td><td>sorghum|13v2|XM_002462764</td><td>971</td><td>941</td><td>84.10</td><td>globlastp</td></tr>
<tr><td>569</td><td>LFS40</td><td>foxtail_millet|14v1|XM_004957537_P1</td><td>972</td><td>941</td><td>83.90</td><td>globlastp</td></tr>
</table>

"P.N." = polynucleotide;
"P.P." = polypeptide;
"Algor." = algorithm (used for sequence alignment and determination of percent homology);
"Hom."—homology;
"iden."—identity;
"glob."—global.

The output of the functional genomics approach described herein is a set of genes highly predicted to improve resistance of a plant to fungal infection by *Fusarium* verticilloides, *Fusarium* graminearum or *Colletotrichum* graminicola when expressed, particularly overexpressed, in said plant. Although each gene is predicted to have its own impact, modifying the mode of expression of more than one gene is expected to provide an additive or synergistic effect on the plant resistance Altering the expression of each gene described herein alone or of a set of genes together increases the overall plant resistance, hence expects to increase agricultural productivity.

Example 3: Genes Correlating with Resistance to Fungal Infection

Experimental Procedures

The association of gene expression with fungal infection was examined in *sorghum* (*Sorghum*), maize (*Zea mays*), wheat (*Triticum* spp), and Barley (*Hordeum* vulgare).

The following pathogenic fungi were used: *Fusarium verticillioides* (hereinafter *F. verticillioides* or Fv). A GFP transformant of *F. verticillioides* strain A-00149-FGSC 7600 (Oren et al., 2003, Appl. Environ. Microbiol. 69:1695) was used throughout the data generation and validation experiments; *Fusarium* graminearum (hereinafter *F. graminearum* or Fv); and *Colletotrichum* graminicola (the asexual reproductive form of *Glomerella* graminicola, hereinafter *C. graminicola* or Cg).

Fungi Infection

The following modes of infection were used:

Direct root fungal infection: this method was used for *F. verticillioides* (Fv) and *Fusarium* graminearum (Fg). Sterilized seeds from tolerant and sensitive lines of the examined plant were germinated on water agar supplemented with Ampicillin (100 μg/ml) and inoculated with a fungal spore suspension ($10^6$/ml) four days after germination. Control plants were mock inoculated with sterile water.

Soil infection: This method was used with *F. verticillioides* (Fv). Sterilized seeds from tolerant and sensitive lines of the examined plant were planted in infected soil (5 g Fv coated barley seeds/liter soil). Control plants were planted in soil inoculated with uninfected sterilized barley seeds.

Direct inoculum injection into plant stalk: This method was used with *F. verticillioides* (Fv) and with the fungus *Colletotrichum* graminicola (hereinafter C. graminicola or Cg). Sterilized seeds from sensitive and resistant lines of the examined plant were planted in soil and inoculated by injecting 100 μl of Fv/Cg spore suspension ($10^6$/ml) into the plant stalk 40 days after planting. Control plants were mock inoculated.

RNA Extraction

RNA extraction was performed using TRIzol Reagent from Invitrogen (invitrogen.com/content.cfm?pageid=469). Approximately 30-50 mg of sample tissue was taken for the analysis. The weighed tissues were ground using pestle and mortar in liquid nitrogen and resuspended in 500 μl of TRIzol Reagent. To the homogenized lysate, 100 μl of chloroform were added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol (QIAGEN Inc, Calif. USA).

RNA was extracted from tissues of the infected and mock plants obtained from each treatment as follows:

Direct root infection—Root and basal stem tissues from plants growing under normal or fungal infection conditions were sampled at 6, 24 and 72 hours post infection (hpi) and RNA was extracted as described hereinbelow.

Soil Infection—Root and stem tissues were sampled at 7 and 15 days post infection (dpi) and RNA was extracted as described hereinbelow.

Stalk Injection—Pith and cortex stem tissues were sampled 2 cm above the injection site at 3 and 7 days post infection (dpi) and RNA was extracted as described hereinbelow.

Identification and Validation of Gene Associated with Fungal Infection

In order to study the association of gene expression in the examined plant species and plant lines with fungal infection, the present inventors utilized available micro-arrays as described in details hereinbelow for each plant species examined. To define correlations between the levels of RNA expression and fungal resistance, parameters related to plant response to fungal infection were analyzed under normal and infected conditions. From plant identified as encompassing variance in the resistance or susceptibility spectrum, hybrids were selected for further association analysis between fungal infection and gene expression after the plants were challenged with *F. verticillioides, F. graminearum* or *C. graminicola* as described hereinabove.

Fungal infection was phenotypes depending on the mode of infection, as follows:

Plants infected via the direct root infection were phenotyped (24 and 72 hpi) for fungal recovery from root and stem tissues by culturing sterilized explants on PDA for 4-5 days and validating the presence of the Fv-GFP strain. For plants infected with Fg, development of necrosis on the roots was monitored along 7 days.

Plants infected via soil inoculation were phenotyped at 7 and 15 dpi for fungal recovery from root and stem tissues by culturing sterilized explants on PDA for 4-5 days. At 85 dpi plants were phenotyped by splitting the stalk and measuring the necrotic stem area.

Plants infected via direct stalk injection were phenotyped at 20 dpi by splitting the stalk and measuring the necrotic stem area and the number infected nodes.

RNA was extracted as described hereinabove.

Production of *Sorghum* Plant Transcriptomes

The association of gene expression in *Sorghum* lines with fungal infection was investigated utilizing a 65K *sorghum* oligonucleotide micro-array, produced by Agilent Technologies [chem.agilent.com/Scripts/PDS.asp?lPage=50879]. The array oligonucleotide represents about 65,000 *sorghum* genes and transcripts. To define correlations between the levels of RNA expression and fungal resistance, parameters related to responses to fungal infection were analyzed in 30 different *Sorghum* hybrids under normal and infected conditions as described hereinabove. Among them, 6 hybrids encompassing variance in the resistance spectrum to *F. verticillioides* (designated as "tolerant" and "sensitive", Table 3) were selected for RNA differential expression analysis after challenge with *F. verticillioides* or *F. graminearum* as described hereinabove.

TABLE 3

Sorghum varieties used for production of transcriptomic data and their phenotypic response to *F. verticillioides* infection

| Variety | Response to *F. verticillioides* |
|---|---|
| STT106 | Tolerant |
| Greentrust Plus | Tolerant |
| PI 291382 | Tolerant |
| PI 533822 | Sensitive |
| PI 656107 | Sensitive |
| PI 533754 | Sensitive |

Production of Maize Transcriptome

The association of gene expression in Maize lines with fungal infection was investigated utilizing a Maize oligonucleotide micro-array, produced by Agilent Technologies [chem.agilent.com/Scripts/PDS.asp?lPage=50879]. The array oligonucleotide represents about 60K Maize genes and transcripts designed based on data from Public databases (Example 1). To define correlations between the levels of RNA expression and fungal resistance, parameters related to responses to fungal infection were analyzed in 30 different Maize hybrids under normal and infected conditions as described hereinabove. Among them, 6 hybrids encompassing variance in the resistance spectrum to *F. verticillioides* or *C. graminicola* (designated as "tolerant" and "sensitive", Table 4 and Table 5, respectively) were selected for RNA expression analysis after challenge with *F. verticillioides, F. graminearum* or *C. graminicola.*

TABLE 4

Maize varieties used for production of transcriptomic data and their phenotypic response to *F. verticillioides* infection

| Variety | Response to *F. verticillioides* |
|---|---|
| 32W86 | Tolerant |
| Klips | Sensitive |
| W182E | Tolerant |
| B84 | Sensitive |
| NC350 | Tolerant |
| Ky WS4 | Sensitive |

TABLE 5

Maize varieties used for production of transcriptomic data and their phenotypic response to *C. graminicola* infection

| Variety | Response to *C. graminicola* |
|---|---|
| Ames3124 | Tolerant |
| PI587129 | Tolerant |
| PI550566 | Sensitive |
| PI576018 | Tolerant |
| PI587130 | Sensitive |
| PI587157 | Sensitive |

Production of Wheat Transcriptome

The association study of wheat lines to fungal infection, the present inventors utilizing a wheat oligonucleotide micro-array, produced by Agilent Technologies [chem.agilent.com/Scripts/PDS.asp?lPage=50879]. The array oligonucleotide represents about 50,000 wheat genes and transcripts.

In order to define correlations between the levels of RNA expression with fungal resistance related parameters, responses to fungal infection of 30 different wheat varieties were analyzed under normal and infected conditions as described hereinabove. Among them, 6 hybrids encompassing variance in the resistance spectrum to *F. verticillioides* (designated as "tolerant" and "sensitive", Table 6) were selected for RNA expression analysis after challenge with *F. verticillioides, F. graminearum*.

TABLE 6

Wheat varieties used for production of transcriptomic data and their phenotypic response to *F. verticillioides* infection

| Variety | Response to *F. verticillioides* |
|---|---|
| Aurore | Sensitive |
| Precoce | Tolerant |
| Barani | Sensitive |
| N46 | Tolerant |
| Bobwhite | Sensitive |
| Thacher | Tolerant |

Differential Expression Analysis

The analysis was preformed via proprietary differential expression algorithm.

The default query parameters used were: >2 fold change, p value<0.01, FDR <0.5. (FDR=false discovery rate). Stringency varied due to specific experimental context.

The following queries were performed across species (aggregated through the use of proprietary ortholog determination), germplasm, organs, types of pathogens treated, and time post infection:

1. Up regulation upon infection: the gene's expression level is higher in infected samples than in mock controls (both resistant and susceptible lines are queried).
2. Stronger expression induction in resistant lines: the gene's expression induction is higher in resistant than in susceptible lines upon infection.
3. Higher basal expression in resistant lines: the gene's expression is higher in resistant than in susceptible lines in uninfected samples.

No type of query is necessary nor sufficient but overall enrichment of positive indications is considered to identify genes significantly qualifying the above criteria.

Results

The genes identified using the above differential expression analyses and the indications found per gene are described hereinbelow:

LAB511

Expression based indications for *Fusarium* or *Colletotrichum* resistance

Maize—The gene was upregulated mainly in the roots of resistant genotypes in response to *Fusarium verticillioides* (Fv) at late infection stages (14 days post infection—dpi). Injection of Fv spores to the stalk resulted in upregulation of the gene in the pith and cortex tissues both at early and late infection stages (3 and 7 dpi). The gene was also upregulated in the roots in response to *Fusarium* graminearum (Fg) (1 and 3 dpi). Following stalk injection of *Colletotrichum* graminicola (Cg), the gene was upregulated in the pith and cortex tissues at late infection stages (7 dpi).

*Sorghum*—The *Sorghum* ortholog was upregulated mainly in the roots of resistant genotypes in response to Fv at early infection stages (6 and 24 hpi). Injection of Fv spores to the stalk induced upregulation of the gene in the pith at late infection stage (7 dpi).

Wheat—The Wheat ortholog was upregulated in the inflorescence in response to Fg at late infection stages (50 hours post infection—hpi).

LFS10

Expression based indications for *Fusarium* or *Colletotrichum* resistance:

Barley—The gene was upregulated mainly at early but also at late stages following inflorescence infection with *Fusarium* graminearum (Fg) (2, 3, 4 and 6 days post infection—dpi) or challenging assays with the mycotoxin Deoxynivalenol (DON) (12 and 24 hours post infection—hpi).

Wheat—The Wheat ortholog was upregulated in the roots in response to *Fusarium* verticillioides (Fv) both at early infection stages (6 and 24 hpi) and at late infection stage (10 dpi). In addition, the gene was upregulated in inflorescences in response to Fg at early infection stages (50 hours post infection—hpi).

*Brachypodium*—The *Brachypodium* ortholog gene was upregulated following spikes inoculation with Fg (96 hpi).

Maize—The gene was upregulated in Maize inflorescence in response to Fv at early infection stage (3 dpi). Injection of Fv spores to the stalk resulted in upregulation of the gene in the pith tissue at late infection stage (7 dpi). An upregulation was observed as well at late infection stage in the roots following Fv inoculation (14 dpi). The gene was also upregulated in the roots in response to Fg (1 and 3 dpi). In addition, the gene was upregulated in the pith following stalk injection of *Colletotrichum* graminicola (Cg) at both early and late infection stages (3 and 7 dpi).

LFS11

Expression based indications for *Fusarium* or *Colletotrichum* resistance:

Maize—The gene was upregulated in the roots of resistant genotypes in response to *Fusarium verticillioides* (Fv) at late infection stages (6 and 14 days post infection—dpi). In addition, the gene was upregulated in the inflorescence of resistant genotype in response to Fv at late infection stage (4 dpi). The gene was also upregulated in the roots in response to *Fusarium* graminearum (Fg) (3 dpi).

*Sorghum*—The *Sorghum* ortholog was upregulated in the roots of resistant genotypes in response to Fv at late infection stages (15 dpi).

LFS13

Expression based indications for *Fusarium* or *Colletotrichum* resistance:

Maize—The gene and other Maize orthologs were upregulated mainly in the inflorescences in response to *Fusarium verticillioides* (Fv) at early infection stages (3 days post infection—dpi). Injection of Fv spores to the stalk resulted in upregulation of the gene in the pith at late infection stages (7 dpi). The gene was also upregulated in the roots in response to *Fusarium* graminearum (Fg) (1 and 3 dpi).

Wheat—The Wheat ortholog was upregulated in the roots in response to Fv both at early and late infection stages (6 and 24 hours post infection—hpi, 5 and 10 dpi, respectively). Also, an upregulation of the gene in the roots was detected following Fg infection (1 and 3 dpi).

*Sorghum*—The *Sorghum* ortholog was upregulated mainly in the roots of resistant genotypes in response to Fv at early infection stages (6 and 24 hpi). Injection of Fv spores to the stalk induced upregulation of the gene in the pith at late infection stage (7 dpi).

LFS14

Expression based indications for *Fusarium* or *Colletotrichum* resistance:

Maize—The gene was upregulated mainly in the roots of resistant genotypes in response to *Fusarium verticillioides* (Fv) at late infection stages (14 days post infection—dpi). In addition, the gene was upregulated in the inflorescences in response to Fv (4 dpi). Injection of Fv spores to the stalk resulted in upregulation of the gene in the pith and cortex tissues both at early and late infection stage (3 and 7 dpi). The gene was also upregulated in the roots in response to *Fusarium* graminearum (Fg) (1 and 3 dpi). In addition, the gene was upregulated in the pith and cortex following stalk injection of *Colletotrichum* graminicola (Cg) at late infection stages (3 and 7 dpi), and was upregulated in the inflorescences in response to Cg infection (6 dpi).

*Sorghum*—The *Sorghum* ortholog was upregulated in the roots in response to Fv at early infection stages (6 and 24 hpi). Injection of Fv spores to the stalk induced an upregulation of the gene in the pith at early infection stage (3 dpi).

LFS15

Expression based indications for *Fusarium* or *Colletotrichum* resistance:

Maize—The gene was upregulated in the roots of resistant genotypes in response to *Fusarium verticillioides* (Fv) at late infection stages (6 and 14 days post infection—dpi). In addition, the gene was upregulated in Maize inflorescence in response to Fv at early infection stage (3 dpi). The gene was also upregulated following inflorescence infection with *Colletotrichum* graminicola (Cg) at late stages (6 dpi).

*Sorghum*—The *Sorghum* ortholog was upregulated in the roots in response to Fv at early infection stages (6 hours post infection—hpi). At 15 dpi the basal expression level of the gene was higher in the roots of resistant genotypes compared to the susceptible ones.

Wheat—The Wheat ortholog was upregulated in the roots of resistant genotypes in response to Fv at early infection stages (6 hpi). In addition, the gene was upregulated in the inflorescence of wheat in response to *Fusarium* graminearum (Fg) at late infection stages (2 and 4 dpi).

LFS16

Expression based indications for *Fusarium* or *Colletotrichum* resistance:

Maize—The gene was upregulated in Maize inflorescence in response to *Fusarium* verticillioides (Fv) (3 and 4 days post infection—dpi). The gene was also upregulated in the roots in response to *Fusarium* graminearum (Fg) (1 and 3 dpi). In addition, the gene was upregulated in both pith and cortex following stalk injection of *Colletotrichum* graminicola (Cg) at early and late infection stages (3 and 7 dpi), and was upregulated in the Maize inflorescence in response to Cg infection (4 and 6 dpi).

Wheat—The Wheat ortholog was upregulated in the roots in response to (Fv) at early infection stages (6 and 24 hours post infection—hpi). In addition, the gene was upregulated in the inflorescence of wheat in response to (Fg) mainly at late, but also at early infection stages (30 and 50 hpi).

Barley—The Barley ortholog gene was upregulated mainly at late, but also at early stages following inflorescence infection with Fg or challenging assays with the mycotoxin Deoxynivalenol (DON).

*Sorghum*—The *Sorghum* ortholog was upregulated in the roots in response to Fv at early infection stages (6 and 24 hpi). At late infection stage, an upregulation was observed in the roots of resistant genotypes (5 and 15 dpi). In addition, injection of Fv spores to the *Sorghum* stalk resulted in upregulation of the gene in the pith tissue at both 3 and 7 dpi.

LFS17

Expression based indications for *Fusarium* or *Colletotrichum* resistance:

Maize—The gene was upregulated in the roots of resistant genotypes in response to *Fusarium verticillioides* (Fv) both at early and late infection stages (6 hours post infection—hpi, 6 and 14 days post infection—dpi, respectively). In addition, the gene was upregulated in the resistant Maize genotype in response to inflorescence infection with Fv, at early stages (3 and 4 days post infection—dpi). The gene was upregulated in the roots in response to *Fusarium* graminearum (Fg) (1 and 3 dpi). In addition, the gene was upregulated in the pith of resistant lines following stalk injection of *Colletotrichum* graminicola (Cg) at late infection stages (7 dpi), and was upregulated in the Maize inflorescence in response to Cg infection (6 dpi).

Wheat—The Wheat ortholog was upregulated in the roots of resistant genotypes in response to (Fv) at early infection stages (6 hours post infection—hpi). In addition, the gene was upregulated in the inflorescence of wheat in response to (Fg) at early infection stages (50 hpi).

Barley—The Barley ortholog gene was upregulated mainly at late but also early stages following inflorescence infection with Fg or challenging assays with the mycotoxin Deoxynivalenol (DON). *Sorghum*—The *Sorghum* ortholog was upregulated in the roots in response to Fv at early infection stages (6 and 24 hpi). In addition, a minor upregulation was observed in the roots at late infection stage (15 dpi). Injection of Cg spores to the *Sorghum* stalk resulted in upregulation of the gene in both pith and cortex tissues at 3 dpi.

LFS18

Expression based indications for *Fusarium* or *Colletotrichum* resistance:

Maize—The gene was upregulated mainly in the roots of resistant genotypes in response to *Fusarium verticillioides* (Fv) both at early and late infection stages (6 hours post infection—hpi, 6 and 14 days post infection dpi). In addition, the gene was upregulated in Maize inflorescence in response to Fv at early infection stage (3 dpi). The gene was also upregulated in the roots in response to *Fusarium* graminearum (Fg) (1 and 3 dpi). In addition, the gene was upregulated both in the pith and cortex tissues following stalk injection of *Colletotrichum* graminicola (Cg) at late infection stages (7 dpi), and was upregulated in the Maize inflorescence in response to Cg infection (4 and 6 dpi).

Wheat—The Wheat ortholog was upregulated mainly in the roots of resistant genotypes in response to Fv at early infection stages (6 and 24 hpi). In addition, the gene was upregulated in the inflorescence of wheat in response to Fg at late infection stages (50 hpi). Barley—The gene was upregulated mainly at early, but also at late stages following inflorescence infection with Fg (2, 3, 4 and 6 dpi) or challenging assays with the mycotoxin Deoxynivalenol (DON) (12 and 24 hpi).

*Sorghum*—The *Sorghum* ortholog was upregulated in the roots in response to Fv both at early and infection stages (6 and 24 hpi, 15 dpi). Injection of Fv spores to the stalk induced an upregulation of the gene in the pith both at early and late infection stages (3 and 7 dpi).

LFS2

Expression based indications for *Fusarium* or *Colletotrichum* resistance:

Barley—The gene was upregulated at both early and late stages following inflorescence infection with *Fusarium* graminearum (Fg) or challenging assays with the mycotoxin Deoxynivalenol (DON) (1, 2, 3, 4 and 6 days post infection—dpi).

Maize—The Maize ortholog was upregulated in the roots of resistant genotypes in response to Fg at early infection stages (24 hours post infection—hpi).

*Sorghum*—The *Sorghum* ortholog was upregulated in the roots in response to *Fusarium* verticillioides (Fv) at early infection stages (24 hpi). In addition, the ortholog was upregulated mainly in the roots of resistant genotypes at late infection stage following Fv infection (5 dpi). Also, an upregulation of the ortholog was observed in the stem, at late infection stage (5 and 15 dpi). Injection of Fv spores to the stalk resulted in local upregulation response of the ortholog at both early and late infection stages (3 and 7 dpi).

Wheat—The Wheat ortholog was upregulated in the roots of mainly resistant genotypes in response to (Fv) at early and late infection stages (1 and 10 dpi). An upregulation was observed in the stem at late Fv infection stages (5 and 10 dpi). In addition, the ortholog was upregulated in response to Fg infection at early stages (inflorescence, 30 and 50 hpi) and in the roots of resistant genotypes at late infection stage (3 dpi).

LFS21

Expression based indications for *Fusarium* or *Colletotrichum* resistance:

Maize—The gene was upregulated in the roots in response to *Fusarium verticillioides* (Fv) at late infection stages (14 days post infection—dpi). In addition, the gene was upregulated in the inflorescences in response to Fv at early infection stage (3 dpi). Injection of Fv spores to the stalk resulted in upregulation of the gene both in the pith (mainly) and cortex tissues at early and late infection stage (3 and 7 dpi). The gene was also upregulated in the roots in response to *Fusarium* graminearum (Fg) (1 and 3 dpi). In addition, the gene was upregulated both in the pith and cortex tissues following stalk injection of *Colletotrichum* graminicola (Cg) at early and late infection stages (3 and 7 dpi), and was upregulated in the inflorescences in response to Cg infection (6 dpi).

*Sorghum*—The *Sorghum* ortholog was upregulated in the pith in response to Fv injection to the stalk (3 and 7 dpi).

Wheat—The Wheat ortholog was upregulated in inflorescence in response to Fg at late infection stages (50 hpi).

LFS22

Expression based indications for *Fusarium* or *Colletotrichum* resistance:

Maize—The gene was upregulated in the inflorescence in response to *Fusarium* verticillioides (Fv) at early infection stage (3 and 4 days post infection—dpi). At late stages, an upregulation was observed mainly in the roots of resistant genotypes following Fv inoculation (6 and 14 dpi). The gene was also upregulated in the roots in response to *Fusarium* graminearum (Fg) (1 and 3 dpi). In addition, the gene was upregulated in both pith and cortex tissues following stalk injection of *Colletotrichum* graminicola (Cg) at early and late infection stages (3 and 7 dpi) and was upregulated in the inflorescence following Cg infection (4 and 6 dpi).

Wheat—The Wheat ortholog was upregulated in the roots of resistant genotypes in response to Fv at early infection stages (6 hours post infection—hpi). The gene was also upregulated in the inflorescence in response to Fg at early infection stages (30 and 50 hpi).

*Sorghum*—The *Sorghum* ortholog was upregulated in the roots in response to Fv at early infection stages (6 hpi). In addition, resistant genotypes showed a higher basal expression level of the gene in the roots, compared to the more susceptible genotypes (15 dpi).

Barley—The Barley ortholog was upregulated at late stages following inflorescence infection with Fg (3, 4 and 6 dpi) or at early stage following challenging assays with the mycotoxin Deoxynivalenol (DON) (12 hours post infection—hpi).

*Arabidopsis*—The *Arabidopsis* ortholog was upregulated following leaf exogenous salicylic acid treatment (3 and 6 hours post treatment).

LFS23

Expression based indications for *Fusarium* or *Colletotrichum* resistance:

Maize—The gene was upregulated at late infection stage in the roots of resistant genotypes following *Fusarium verticillioides* Fv inoculation (14 days post infection—dpi). An upregulation was observed as well in inflorescences in response to Fv at early infection stage (3 dpi). The gene was also upregulated in the roots in response to *Fusarium* graminearum (Fg) (1 and 3 dpi). In addition, the gene was upregulated in the pith and cortex tissues following stalk injection of *Colletotrichum* graminicola (Cg) at early and late infection stages (3 and 7 dpi), and was upregulated in the Maize inflorescence in response to Cg infection (6 dpi).

Wheat—The Wheat ortholog was upregulated in the roots in response to Fv at early infection stages (6 and 24 hours post infection—hpi). In addition, the gene was upregulated in inflorescences in response to Fg at early infection stages (30 and 50 hpi).

Barley—The gene was upregulated mainly at early but also at late stages following inflorescence infection with Fg (3 and 4 dpi) or challenging assays with the mycotoxin Deoxynivalenol (DON) (12 hpi).

*Brachypodium*—The *Brachypodium* ortholog gene was upregulated following spikes inoculation with Fg (96 hpi).

*Sorghum*—The *Sorghum* ortholog was upregulated in the roots in response to Fv at early infection stages (6 and 24 hpi).

LFS24

Expression based indications for *Fusarium* or *Colletotrichum* resistance:

Maize—The gene was upregulated at late infection stage in the roots of resistant genotypes following *Fusarium verticillioides* (Fv) inoculation (14 days post infection—dpi). Injection of Fv spores to the stalk resulted in upregulation of the gene in the pith tissue at late infection stage (7 dpi). An upregulation was observed as well in inflorescences in response to Fv at early infection stage (4 dpi). The gene was also upregulated in the roots in response to *Fusarium* graminearum (Fg) (1 and 3 dpi). In addition, the gene was upregulated in both pith and cortex following stalk injection of *Colletotrichum* graminicola (Cg) at late infection stages (3 and 7 dpi), and was upregulated in the Maize inflorescence in response to Cg infection (4 and 6 dpi).

Wheat—The Wheat ortholog was upregulated in the roots of resistant genotypes in response to (Fv) at early infection stages (6 hours post infection—hpi) and in all genotypes at 24 hpi. In addition, the gene was upregulated in the inflorescence of wheat in response to (Fg) at mainly late, but also early infection stages (30 and 50 hours post infection—hpi).

Barley—The Barley ortholog gene was upregulated at late stages following inflorescence infection with Fg (4 dpi).

*Sorghum*—The *Sorghum* ortholog was upregulated in the roots in response to Fv at early infection stages (6 and 24 hpi). In addition, injection of Fv spores to the *Sorghum* stalk resulted in upregulation of the gene in the pith tissue at both 3 and 7 dpi. At 15 dpi it was observed that resistant genotypes presented higher basal expression level of the ortholog in the roots compared to the susceptible genotypes.

LFS25

Expression based indications for *Fusarium* or *Colletotrichum* resistance:

Maize—The gene was upregulated in the roots of resistant genotypes in response to *Fusarium verticillioides* (Fv) both at early and late infection stages (6 hours post infection—hpi, 6 and 14 days post infection—dpi). Injection of Fv spores to the stalk resulted in upregulation of the gene in the pith at both early and late infection stages (3 and 7 dpi). In addition, the gene was upregulated in response to inflorescence infection with Fv, at early stages (3 and 4 days post infection—dpi). The gene was also upregulated in the roots in response to *Fusarium* graminearum (Fg) (1 and 3 dpi). Following stalk injection of *Colletotrichum* graminicola (Cg) spores an upregulation of the gene was observed in both pith and cortex tissues at late stages of infection (7 dpi). Inflorescence infection with Cg also resulted in upregulation of the gene (4 and 6 dpi).

*Sorghum*—The *Sorghum* ortholog was upregulated in the roots in response to Fv at early infection stages (6 and 24 hpi). In addition, upregulation was observed in the roots of resistant genotypes at late infection stage (6 dpi). Injection of Fv spores to the stalk resulted in upregulation of the gene in the pith at 3 and 7 dpi.

Wheat—The Wheat ortholog was upregulated in the roots of resistant genotypes in response to Fv at early infection stages (6 hpi). Also, the gene was upregulated in the inflorescence in response to Fg (30 and 50 hpi).

Barley—The Barley ortholog was upregulated at late stages following inflorescence infection with Fg (3, 4 and 6 dpi) or at early stage following challenging assays with the mycotoxin Deoxynivalenol (DON) (12 and 14 hpi).

*Arabidopsis*—The *Arabidopsis* ortholog was upregulated following exogenous salicylic acid treatment of the leaves (3, 6, 12 and 24 hours post treatment).

LFS26

Expression based indications for *Fusarium* or *Colletotrichum* resistance:

Maize—The gene was upregulated in the roots of resistant genotypes in response to *Fusarium verticillioides* (Fv) both at early and late infection stages (6 hours post infection—hpi, 14 days post infection—dpi, respectively). Injection of Fv spores to the stalk resulted in upregulation of the gene in the pith tissue at late infection stage (7 dpi). In addition, the gene was upregulated in inflorescences in response to Fv at early infection stage (3 and 4 dpi). The gene was also upregulated in the roots in response to *Fusarium* graminearum (Fg) (3 dpi). In addition, the gene was upregulated in the pith following stalk injection of *Colletotrichum* graminicola (Cg) at late infection stages (7 dpi), and was upregulated in the Maize inflorescence in response to Cg infection (6 dpi).

Wheat—The Wheat ortholog was upregulated in the roots of resistant genotypes in response to (Fv) at early infection stages (6 hours post infection—hpi). In addition, the gene was upregulated in the inflorescence of wheat in response to (Fg) at early infection stages (50 hours post infection—hpi).

Barley—The Barley ortholog gene was upregulated mainly at early, but also late stages following inflorescence infection with Fg or challenging assays with the mycotoxin Deoxynivalenol (DON).

*Sorghum*—The *Sorghum* ortholog was upregulated in the roots in response to Fv at early infection stages (6 and 24 hpi).

LFS27

Expression based indications for *Fusarium* or *Colletotrichum* resistance:

Maize—The gene was upregulated mainly in the roots of resistant genotypes in response to *Fusarium verticillioides* (Fv) both at early and late infection stages (6 hours post infection—hpi, 6 and 14 days post infection—dpi). In addition, the gene was upregulated in inflorescences in response to Fv at early infection stage (3 and 4 days post infection—dpi). Injection of Fv spores to the stalk resulted in upregulation of the gene in the pith tissue at late infection stage (7 dpi). The gene was also upregulated in the roots in response to *Fusarium* graminearum (Fg) (1 and 3 dpi). In addition, the gene was upregulated in the pith following stalk injection of *Colletotrichum* graminicola (Cg) at late infection stages (7 dpi), and was upregulated in the Maize inflorescence in response to Cg infection (4 and 6 dpi).

*Sorghum*—The *Sorghum* ortholog was upregulated in the roots in response to Fv at early infection stages (6 hpi).

LFS28

Expression based indications for *Fusarium* or *Colletotrichum* resistance:

Maize—The gene was upregulated in the roots of resistant genotypes in response to *Fusarium verticillioides* (Fv) both at early and late infection stages (6 and 24 hours post infection—hpi, 14 days post infection—dpi, respectively). Injection of Fv spores to the stalk resulted in upregulation of the gene mainly of the resistant genotypes, in the pith and cortex tissues (3 dpi). In addition, the gene was upregulated in inflorescences in response to Fv at early infection stage (3 and 4 dpi). The gene was also upregulated in the roots of mainly resistant genotypes in response to *Fusarium* graminearum (Fg) (1 and 3 dpi). In addition, the gene was upregulated in the pith and the cortex tissues following stalk injection of *Colletotrichum* graminicola (Cg) spores at late infection stages (7 dpi), and was upregulated in the Maize inflorescence in response to Cg infection (1.5, 4 and 6 dpi).

*Sorghum*—The *Sorghum* ortholog was upregulated in the roots in response to Fv at early infection stages (6 and 24 hpi).

*Brachypodium*—The *Brachypodium* ortholog gene was upregulated following spikes inoculation with Fg (96 hpi).

LFS3

Expression based indications for *Fusarium* or *Colletotrichum* resistance:

Barley—The gene was upregulated at both early and late stages following inflorescence infection with *Fusarium graminearum* (Fg) (3, 4 and 6 days post infection—dpi) or challenging assays with the mycotoxin Deoxynivalenol (DON) (12 and 24 hours post infection—hpi). Maize—The Maize ortholog was upregulated in the roots of resistant genotypes in response to *Fusarium verticillioides* (Fv) at early and late infection stages (6 hpi, 6 and 14 dpi, respectively). The ortholog was upregulated as well in inflorescences in response to Fv infection (3 dpi). An upregulation was also observed in the roots in response to Fg infection (1 and 3 dpi). Injection of *Colletotrichum* graminicola (Cg) spores to the stalk induced upregulation of the gene in the pith and cortex tissues at late infection stages (7 dpi). As well, an upregulation at late infection stage was observed in the inflorescence following Cg infection (4 and 6 dpi).

*Sorghum*—The *Sorghum* ortholog was upregulated in the roots in response to *Fusarium* verticillioides (Fv) at late infection stages (15 dpi). Injection of Fv spores to the stalk resulted in upregulation of the gene in the pith tissue (3 and 7 dpi).

Wheat—The Wheat ortholog was upregulated in the roots in response to Fv at early infection stages (6 and 24 hpi). Also, upregulation was observed mainly in the roots of resistant genotypes following Fg infection (6 hpi). In addition, the ortholog was upregulated in inflorescences in response to Fg infection at early stages (30 and 50 hpi).

*Brachypodium*—The *Brachypodium* ortholog gene was upregulated following spikes inoculation with Fg (96 hpi).

LFS30

Expression based indications for *Fusarium* or *Colletotrichum* resistance:

Maize—The gene was upregulated in the roots of resistant genotypes in response to *Fusarium verticillioides* (Fv) at both early and infection stages (6 hours post infection—hpi, 6 and 14 days post infection—dpi). The gene was also upregulated in the roots in response to *Fusarium graminearum* (Fg) (1 and 3 dpi). In addition, the gene was upregulated in Maize inflorescence in response to Fv at early infection stage (3 dpi). Moreover, the gene was upregulated in the pith following stalk injection of *Colletotrichum* graminicola (Cg) at late infection stages (7 dpi), and was upregulated in the Maize inflorescence in response to Cg infection (6 dpi).

Wheat—The Wheat ortholog was upregulated in the inflorescence in response to (Fg) at late infection stages (48 and 96 hpi).

Barley—The gene was upregulated at early stages following inflorescence challenging assays with the mycotoxin Deoxynivalenol (DON) (12 and 24 hpi).

*Sorghum*—The *Sorghum* ortholog was upregulated in the roots in response to Fv at both early and late infection stages (6 and 24 hpi, 15 dpi, respectively). Injection of Fv spores to the stalk resulted in upregulation of the gene in the pith tissue at late stage of infection (7 dpi).

LFS31

Expression based indications for *Fusarium* or *Colletotrichum* resistance:

Maize—The gene and other Maize orthologs were upregulated mainly in the roots of resistant genotypes in response to *Fusarium verticillioides* (Fv) both at early and late infection stages (6 hours post infection—hpi, 6 days post infection—dpi, respectively). Injection of Fv spores to the stalk resulted in upregulation of the gene in the pith and cortex tissues at late infection stages (7 dpi). In addition, an upregulation was detected in the inflorescences in response to Fv at early infection stages (3 dpi). The gene was also upregulated in the roots in response to *Fusarium graminearum* (Fg) (1 and 3 dpi). The gene was also upregulated in the pith following stalk injection of *Colletotrichum* graminicola (Cg) at late infection stages (7 dpi), and was upregulated in the Maize inflorescence in response to Cg infection (6 dpi).

Wheat—The Wheat ortholog was upregulated mainly in the roots of resistant genotypes in response to Fv at early infection stage (6 hpi). The gene was also upregulated in the roots of resistant genotypes detected following Fg infection (1 dpi) and was upregulated in the inflorescences in response to Fg (50 hpi).

*Sorghum*—The *Sorghum* ortholog was upregulated in the roots in response to Fv both at early and late infection stages (6 and 24 hpi, 5 and 15 dpi, respectively).

LFS32

Expression based indications for *Fusarium* or *Colletotrichum* resistance:

Maize—The gene was upregulated mainly in the roots of resistant genotypes in response to *Fusarium verticillioides* (Fv) at late infection stage (14 days post infection—dpi). In addition, the gene was upregulated in inflorescences in response to Fv at early infection stage (3 dpi). Injection of Fv spores to the stalk resulted in upregulation of the gene in the cortex tissue of resistant genotypes at early infection stage (3 dpi). The gene was also upregulated in the roots in response to *Fusarium graminearum* (Fg) (1 and 3 dpi). In addition, the gene was upregulated in the pith following stalk injection of *Colletotrichum* graminicola (Cg) both at early and late infection stages (3 and 7 dpi), and was upregulated in the Maize inflorescence in response to Cg infection (6 dpi).

*Sorghum*—The *Sorghum* ortholog was upregulated in the roots in response to Fv both at early and late infection stages (6 and 24 hpi, and 5 dpi, respectively).

*Brachypodium*—The *Brachypodium* ortholog gene was upregulated following spikes inoculation with Fg (96 hpi).

LFS33

Expression based indications for *Fusarium* or *Colletotrichum* resistance:

Maize—The gene was upregulated at late infection stage in the roots of resistant genotypes following *Fusarium verticillioides* (Fv) inoculation (6 and 14 days post infection—dpi). An upregulation was observed as well in Maize inflorescences in response to Fv at early infection stage (3 and 4 dpi). The gene was also upregulated in the roots in response to *Fusarium graminearum* (Fg) (3 dpi). In addition, the gene was upregulated in the inflorescence in response to *Colletotrichum* graminicola (Cg) infection (6 dpi).

*Sorghum*—The *Sorghum* ortholog was upregulated in the roots in response to Fv at early infection stages (24 hpi). Injection of Fv spores to the stalk resulted in upregulation of the gene in the pith tissue (3 and 7 dpi).

LFS34

Expression based indications for *Fusarium* or *Colletotrichum* resistance:

Maize—The gene was upregulated in the roots in response to *Fusarium verticillioides* (Fv) at late infection stages (14 days post infection—dpi). In addition, the gene was upregulated in inflorescences in response to Fv at early infection stage (3 dpi). The gene was also upregulated in the roots in response to *Fusarium graminearum* (Fg) (3 dpi). In addition, the gene was upregulated in the pith following stalk injection of *Colletotrichum* graminicola (Cg) both at early and late infection stages (3 and 7 dpi), and was upregulated in the Maize inflorescence in response to Cg infection (6 dpi).

Wheat—The Wheat ortholog was upregulated in the roots in response to Fv both at early and late infection stages (24 hours post infection—hpi, 10 dpi, respectively). In addition, the gene was upregulated in the inflorescence of wheat in response to Fg at early infection stages (50 hpi).

Barley—The gene was upregulated at late stages following inflorescence infection with Fg (3, 4 and 6 dpi) *Brachypodium*—The *Brachypodium* ortholog gene was upregulated following spikes inoculation with Fg (96 hpi).

LFS35

Expression based indications for *Fusarium* or *Colletotrichum* resistance:

Maize—The gene was upregulated in the roots of resistant genotypes in response to *Fusarium verticillioides* (Fv) at late infection stages (14 days post infection—dpi). The gene was also upregulated in the inflorescence following Fv infection (3 dpi). Injection of Fv spores to the stalk resulted in upregulation of the gene in the pith and cortex tissues tissue at late infection stage (3 and 7 dpi). The gene was also upregulated in the roots in response to *Fusarium graminearum* (Fg) (1 and 3 dpi). In addition, the gene was upregulated in the pith and cortex tissues following stalk injection of *Colletotrichum graminicola* (Cg) at late infection stages (7 dpi), and was upregulated in the Maize inflorescence in response to Cg infection (6 dpi).

*Sorghum*—The *Sorghum* ortholog was upregulated in the roots in response to Fv at early and late infection stages (6 and 24 hpi, 5 dpi, respectively). Injection of Fv spores to the stalk induced upregulation of the gene in the (3 dpi).

Wheat—The Wheat ortholog was upregulated in the roots in response to Fv at early infection stages (6 hpi).

LFS36

Expression based indications for *Fusarium* or *Colletotrichum* resistance:

Maize—The gene was upregulated in the inflorescence in response to *Fusarium* verticillioides (Fv) at early infection stage (3 days post infection—dpi). Injection of Fv spores to the stalk resulted in upregulation of the gene in the pith (3 and 7 dpi) and in the cortex (7 dpi). Upregulation was observed as well at late infection stage in the roots of resistant genotypes following Fv inoculation (6 and 14 dpi). The gene was also upregulated in the roots in response to *Fusarium graminearum* (Fg) (1 and 3 dpi). In addition, the gene was upregulated in the cortex following stalk injection of *Colletotrichum graminicola* (Cg) (3 and 7 dpi) and was upregulated in the inflorescence following Cg infection (4 and 6 dpi).

Wheat—The Wheat ortholog was upregulated in the roots in response to Fv at early infection stages (hours post infection—hpi). The gene was also upregulated in the roots of resistant genotypes in response to Fg (1 and 3 dpi). *Sorghum*—The

*Sorghum* ortholog was upregulated in the roots in response to Fv at early infection stages (6 and 24 hpi).

LFS37

Expression based indications for *Fusarium* or *Colletotrichum* resistance:

Maize—The gene was upregulated mainly in the roots of resistant genotypes in response to *Fusarium verticillioides* (Fv) at late infection stages (6 and 14 days post infection—dpi). In addition, the gene was upregulated in inflorescences in response to Fv at early infection stage (3 dpi). The gene was also upregulated in the roots in response to *Fusarium graminearum* (Fg) (3 dpi). Moreover, the gene was upregulated in the inflorescences following infection with *Colletotrichum graminicola* (Cg) at late infection stages (4 and 6 dpi).

*Sorghum*—The *Sorghum* ortholog was upregulated in the roots in response to Fv at early infection stages (6 hours post infection—hpi).

Wheat—The Wheat ortholog was upregulated in the roots of resistant genotypes in response to Fv at early infection stages (6 hpi). In addition, the gene was upregulated in the inflorescence of wheat in response to Fg at early infection stages (50 hpi).

Barley—The gene was upregulated mainly at early, but also at late stages following inflorescence infection with Fg (3 and 4 dpi).

LFS38

Expression based indications for *Fusarium* or *Colletotrichum* resistance:

Maize—The gene was upregulated in the roots in response to *Fusarium verticillioides* (Fv) at early and late infection stages (6 hours post infection—hpi, and days post infection—dpi, respectively). In addition, the gene was upregulated in inflorescences in response to Fv at early infection stage (3 dpi). The gene was also upregulated in the roots in response to *Fusarium graminearum* (Fg) (1 and 3 dpi). In addition, the gene was upregulated in the cortex following stalk injection of *Colletotrichum graminicola* (Cg) at late infection stages (7 dpi), and was upregulated in the inflorescences in response to Cg infection (6 dpi).

*Sorghum*—The *Sorghum* ortholog was upregulated in the roots in response to Fv at early and late infection stages (6 hpi and 5 dpi).

Wheat—The Wheat ortholog was upregulated in the roots of resistant genotypes in response to Fv at early infection stages (6 and 24 hpi). In addition, the gene was upregulated in inflorescences in response to (Fg) at early infection stages (50 hpi).

LFS39

Expression based indications for *Fusarium* or *Colletotrichum* resistance:

Maize—The gene was upregulated in the roots of resistant genotypes in response to *Fusarium verticillioides* (Fv) both at early and late infection stages (6 and 24 hours post infection—hpi, 14 days post infection—dpi). Injection of Fv spores to the stalk resulted in upregulation of the gene in the pith and cortex tissues at both early and late infection stages (3 and 7 dpi). In addition, the gene was upregulated in Maize inflorescence in response to Fv at early infection stage (3 dpi). The gene was also upregulated in the roots of mainly resistant genotypes in response to *Fusarium graminearum* (Fg) (1 and 3 dpi). In addition, the gene was upregulated in the pith tissue following stalk injection of *Colletotrichum graminicola* (Cg) spores at late infection stages (7 dpi), and was upregulated in the Maize inflorescence in response to Cg infection (6 dpi).

*Sorghum*—The *Sorghum* ortholog was upregulated in the roots in response to Fv at early infection stages (6 hpi). At 24 hpi, an upregulation was observed mainly in roots of the resistant genotypes. Injection of Fv spores to the stalk resulted in minor upregulation of the gene in the cortex tissue (3 dpi).

Wheat—The Wheat ortholog was upregulated in the inflorescence in response to Fg at late infection stage (50 hpi).

LFS4

Expression based indications for *Fusarium* or *Colletotrichum* resistance:

Barley—The gene was upregulated at both early and late stages following inflorescence infection with *Fusarium graminearum* (Fg) (3, 4 and 6 days post infection—dpi) or challenging assays with the mycotoxin Deoxynivalenol (DON) (12 and 24 hours post infection—hpi).

Maize—The Maize ortholog was upregulated in the roots of resistant genotypes in response to *Fusarium verticillioides* (Fv) at early and late infection stages (6 hpi and 14 dpi, respectively). The ortholog was upregulated as well in inflorescences in response to Fv infection (3 dpi). An upregulation was also observed in the roots in response to Fg infection (1 and 3 dpi). Injection of *Colletotrichum graminicola* (Cg) spores to the stalk induced upregulation of the gene in the cortex at early infection stage (3 dpi). Also, an upregulation at late infection stage was observed in the inflorescence following Cg infection (6 dpi).

*Sorghum*—The *Sorghum* ortholog was upregulated in the roots in response to Fv at early infection stages (6 and 24 hpi). Wheat—The Wheat ortholog was upregulated in the roots in response to Fv at early infection stages (6 and 24 hpi). In addition, the ortholog was upregulated in the inflorescence in response to Fg infection at early stages (30 and 50 hpi).

LFS40

Expression based indications for *Fusarium* or *Colletotrichum* resistance

Maize—The gene was upregulated mainly in the roots of resistant genotypes in response to *Fusarium verticillioides* (Fv) at early infection stages (6 hours post infection—hpi). The gene was also upregulated in the roots in response to *Fusarium graminearum* (Fg) (1 and 3 days post infection—dpi).

*Sorghum*—The *Sorghum* ortholog was upregulated in the roots in response to Fv at early infection stages (6 and 24 hpi).

LFS42

Expression based indications for *Fusarium* or *Colletotrichum* resistance:

Maize—The gene was upregulated in the roots of resistant genotypes in response to *Fusarium verticillioides* (Fv) at early infection stages (6 hours post infection—hpi). The gene was also upregulated in the roots of resistant genotypes in response to *Fusarium* graminearum (Fg) (1 and 3 days post infection—dpi).

*Sorghum*—The *Sorghum* ortholog was upregulated in the roots in response to Fv at early infection stages (6 and 24 hpi).

LFS43

Expression based indications for *Fusarium* or *Colletotrichum* resistance

Maize—Injection of *Fusarium verticillioides* (Fv) spores to the stalk resulted in upregulation of the gene in the pith tissue at 3 and 7 days post infection—dpi. Upregulation was observed as well at late infection stage in the roots of resistant genotypes following Fv inoculation (6 and 14 dpi). The gene was also upregulated in the inflorescence in response to Fv at early infection stage (3 dpi). The gene was upregulated in the roots in response to *Fusarium graminearum* (Fg) (1 and 3 dpi). In addition, the gene was upregulated in both pith and cortex tissues following stalk injection of *Colletotrichum graminicola* (Cg) at early and late infection stages (3 and 7 dpi).

Wheat—The Wheat ortholog was upregulated in the roots in response to Fv at early infection stages (6 and 24 hours post infection—hpi). The gene was upregulated as well in the roots in response to Fg at early infection stage (24 hpi) and in the inflorescence at 30 and 50 hpi). *Sorghum*—The *Sorghum* ortholog was upregulated in the roots in response to Fv at early infection stages (6 and 24 hpi). In addition, a late response was observed in the roots following Fv infection (15 dpi). Injection of Fv spores to the stalk resulted in upregulation of the gene in the pith (3 and 7 dpi) and cortex (3 dpi).

LFS44

Expression based indications for *Fusarium* or *Colletotrichum* resistance:

Maize—The gene was upregulated mainly in the roots of resistant genotypes in response to *Fusarium verticillioides* (Fv) at late infection stages (6 and 14 days post infection—dpi). In addition, the gene was upregulated in inflorescences in response to Fv at early infection stage (3 dpi). The gene was also upregulated in the roots in response to *Fusarium graminearum* (Fg) (3 dpi). In addition, the gene was upregulated mainly in the pith of resistant genotypes following stalk injection of *Colletotrichum* graminicola (Cg) both at early and late infection stages (3 and 7 dpi), and was upregulated in the Maize inflorescence in response to Cg infection (6 dpi).

Wheat—The Wheat ortholog was upregulated in the stem in response to Fv at late infection stages (5 dpi). In addition, the gene was upregulated in the inflorescence in response to Fg at late infection stages (50 hours post infection—hpi).

*Sorghum*—The *Sorghum* ortholog was upregulated in the roots in response to Fv both at early and late infection stages (6 and 24 hpi, 15 dpi, respectively). Injection of Fv spores to the stalk induced upregulation of the gene in the pith both at early and late infection stages (3 and 7 dpi). *Brachypodium*—The *Brachypodium* ortholog gene was upregulated following spikes inoculation with Fg (96 hpi).

LFS45

Expression based indications for *Fusarium* or *Colletotrichum* resistance:

*Sorghum*—The gene was upregulated in the roots in response to *Fusarium* verticillioides (Fv) both at early and late infection stages (6 and 24 hours post infection—hpi, 6 and 14 days post infection—dpi). Injection of Fv spores to the stalk induced upregulation of the gene in the pith (3 and 7 dpi).

Maize—The Maize ortholog was upregulated in the inflorescences in response to Fv (3 and 4 dpi). As well, an upregulation in the roots was detected following *Fusarium* graminearum (Fg) infection (3 dpi). Injection of *Colletotrichum graminicola* (Cg) spores to the stalk resulted in upregulation of the gene in the pith (3 and 7 dpi) and cortex (3 dpi). In addition, an upregulation of the ortholog was detected in the inflorescence in response to Cg infection (4 and 6 dpi). Wheat—The Wheat ortholog was upregulated in inflorescences in response to Fg both at early and late infection stages (30 and 50 hpi).

LFS46

Expression based indications for *Fusarium* or *Colletotrichum* resistance:

*Sorghum*—The gene was upregulated in response to *Fusarium verticillioides* (Fv) in roots of all genotypes at early infection stages, whereas in resistant genotypes there was upregulation also at late infection stages (6 and 24 hours post infection—hpi, 5 days post infection—dpi, respectively).

Maize—The Maize ortholog was upregulated in the roots of all genotypes at early infection stage and mainly in resistant genotypes at late infection stages in response to Fv (6 hpi and 6 dpi, respectively). The gene was also upregulated in the roots in response to *Fusarium graminearum* (Fg) (1 and 3 dpi).

Wheat—The Wheat ortholog was upregulated in the roots of resistant genotypes in response to (Fv) at early infection stages (6 hpi). In addition, the gene was upregulated in inflorescences in response to Fg at late infection stages (50 hpi).

Barley—The gene was upregulated mainly at early, but also at late stages following inflorescence infection with Fg (4 dpi) or challenging assays with the mycotoxin Deoxynivalenol (DON) (24 hpi).

LFS47

Expression based indications for *Fusarium* or *Colletotrichum* resistance:

*Sorghum*—The gene was upregulated in the roots of resistant genotypes in response to *Fusarium verticillioides* (Fv) at late infection stages (6 and 14 days post infection—dpi). Injection of Fv spores to the stalk induced upregulation of the gene in the pith (3 dpi).

Maize—The Maize ortholog was upregulated in the roots of resistant genotypes in response to Fv at late infection stage (14 dpi). The ortholog was also upregulated in the inflorescence in response to Fv (3 dpi). Also, an upregulation in the roots was detected mainly in resistant genotypes following *Fusarium graminearum* (Fg) infection (1 and 3 dpi). Injection of *Colletotrichum graminicola* (Cg) spores to the stalk resulted in upregulation of the gene in the pith tissue at late infection stage (3 and 7 dpi). In addition, a minor upregulation of the ortholog was detected in the inflorescence in response to Cg infection (6 dpi).

Wheat—The Wheat ortholog was upregulated in the roots of resistant genotypes in response to Fv at early infection stages (6 hpi). In addition, the gene was upregulated mainly in the inflorescence of resistant genotypes in response to Fg at late infection stages (50 hpi).

LFS48

Expression based indications for *Fusarium* or *Colletotrichum* resistance:

*Sorghum*—The gene was upregulated in the roots in response to *Fusarium* verticillioides (Fv) at early infection stages (6 and 24 hours post infection—hpi).

Maize—The Maize ortholog was upregulated mainly in the roots of resistant genotypes in response to Fv at early infection stage (6 hpi). The ortholog was also upregulated in the inflorescence in response to Fv (3 dpi). Also, an upregulation in the roots was detected following *Fusarium graminearum* (Fg) infection (1 and 3 dpi). In addition, an upregulation of the ortholog was detected in the inflorescence in response to *Colletotrichum graminicola* (Cg) infection (6 dpi).

Barley—The gene was upregulated mainly at early but also at late stages following inflorescence infection with Fg (3 and 4 dpi) or challenging assays with the mycotoxin Deoxynivalenol (DON) (12 hpi).

LFS49

Expression based indications for *Fusarium* or *Colletotrichum* resistance:

Maize—The gene was upregulated mainly in the roots of resistant genotypes in response to *Fusarium verticillioides* (Fv) at early infection stages (6 hours post infection—hpi). The gene was also upregulated in the roots in response to *Fusarium graminearum* (Fg) (1 and 3 days post infection—dpi).

*Sorghum*—The *Sorghum* ortholog was upregulated in the roots in response to Fv at early infection stages (6 and 24 hpi).

LFS50

Expression based indications for *Fusarium* or *Colletotrichum* resistance:

*Sorghum*—The gene was upregulated in the roots in response to *Fusarium* verticillioides (Fv) at early infection stages (6 hours post infection—hpi).

Maize—The Maize ortholog was upregulated in the roots of resistant genotypes in response to Fv at early infection stages (6 hpi). The ortholog was also upregulated in inflorescences of resistant genotypes in response to Fv at early infection stage (3 dpi). As well, an upregulation in the roots was detected following *Fusarium graminearum* (Fg) infection (1 and 3 dpi). Injection of *Colletotrichum graminicola* (Cg) spores to the stalk resulted in upregulation of the gene in the pith tissue at early infection stage (3 dpi). In addition, the ortholog was upregulated in the inflorescence in response to Cg at late infection stage (4 and 6 dpi).

Wheat—The Wheat ortholog was upregulated in the roots of resistant genotypes in response to Fv at early infection stages (6 hpi). Also, the gene was upregulated mainly at the inflorescence of resistant genotypes in response to Fg at both early and late infection stages (30 and 50 hpi. 2 and 4 days post infection—dpi).

Barley—The gene was upregulated mainly at early, but also at late stages following inflorescence infection with *Fusarium graminearum* (Fg) (48, 72, 96 and 144 hpi) or challenging assays with the mycotoxin Deoxynivalenol (DON) (12 and 24 hours post infection—hpi).

LFS51

Expression based indications for *Fusarium* or *Colletotrichum* resistance:

*Sorghum*—The gene was upregulated in response to *Fusarium verticillioides* (Fv) in roots at early infection stages (6 and 24 hours post infection—hpi). Injection of Fv spores to the stalk induced upregulation of the gene in the pith, both at early and late infection stages (3 and 7 days post infection—dpi).

Maize—The Maize ortholog was upregulated in the inflorescence in response to Fv infection (3 and 4 dpi). In addition, upregulation in the inflorescence was detected following *Colletotrichum graminicola* infection (6 dpi).

Wheat—The Wheat ortholog was upregulated in the roots of resistant genotypes in response to Fv at early infection stages (6 hpi). In addition, the gene was upregulated in inflorescences in response to Fg both at early and late infection stages (30 and 50 hpi). Barley—The gene was upregulated mainly at early but also at late stages following inflorescence infection with Fg (2, 3, 4 and 6 dpi) or challenging assays with the mycotoxin Deoxynivalenol (DON) (12 and 24 hpi). *Brachypodium*—The *Brachypodium* ortholog gene was upregulated following spikes inoculation with Fg (96 hpi).

LFS52

Expression based indications for *Fusarium* or *Colletotrichum* resistance:

*Sorghum*—The gene was upregulated in the roots in response to *Fusarium* verticillioides (Fv) at early infection stages (6 hours post infection—hpi). At late infection stage a minor upregulation in the roots was observed (14 days post infection—dpi).

Maize—The Maize ortholog was upregulated in the roots of mainly resistant genotypes in response to Fv at early and late infection stages (6 hpi, 6 and 14 dpi, respectively). The ortholog was also upregulated in inflorescences of resistant genotypes in response to Fv at early infection stages (3 dpi). Also, upregulation in the roots was detected following *Fusarium graminearum* (Fg) infection (3 dpi). Injection of Fv spores to the stalk induced upregulation of the gene in the pith and cortex tissues (3 and 7 dpi). Injection of *Colletotrichum graminicola* (Cg) spores to the stalk resulted in upregulation of the gene in the pith tissue at late infection stage (7 dpi). In addition, the ortholog was upregulated in the inflorescence in response to Cg at late infection stage (6 dpi).

Wheat—The Wheat ortholog was upregulated in the roots of resistant genotypes in response to Fv at early infection stages (24 hpi). The gene was also upregulated mainly in inflorescences of resistant genotypes in response to Fg at late infection stages (50 hpi). Barley—The gene was upregulated mainly at early, but also at late stages following inflorescence infection with *Fusarium graminearum* (Fg) (72, 96 and 144 hpi) or challenging assays with the mycotoxin Deoxynivalenol (DON) (12 and 24 hours post infection—hpi).

*Brachypodium*—The *Brachypodium* ortholog was upregulated following spikes inoculation with Fg (96 hpi).

LFS53

Expression based indications for *Fusarium* or *Colletotrichum* resistance:

*Sorghum*—The gene was upregulated in the roots in response to *Fusarium* verticillioides (Fv) at early infection stages (6 and 24 hours post infection—hpi). In addition, an upregulation was observed in the roots of resistant genotypes at late infection stage (5 days post infection—dpi). Injection of Fv spores to the *Sorghum* stalk resulted in upregulation of the gene at the pith tissue at 3 and 7 dpi.

Wheat—The Wheat ortholog was upregulated in the roots in response to Fv at early infection stages (6 and 24 hpi). A minor upregulation was observed in both roots and stem following infection with Fv (10 dpi). In addition, the gene was upregulated in the roots in response to *Fusarium graminearum* (Fg) (1 and 3 dpi). As well the gene was upregulated in the inflorescence of wheat in response to *Fusarium graminearum* (Fg) at early infection stages (30 and 50 hpi).

Maize—The Maize ortholog was upregulated in the roots of resistant genotypes in response to Fv at late infection stages (14 dpi). The ortholog was also upregulated in Maize inflorescence in response to Fv at early infection stage (4 dpi). In addition, the ortholog was upregulated in the inflorescence in response to *Colletotrichum* graminicola (Cg) at late infection stage (4 and 6 dpi). *Brachypodium*—The *Brachypodium* ortholog gene was upregulated following spikes inoculation with Fg (96 hpi).

LFS54

Expression based indications for *Fusarium* or *Colletotrichum* resistance:

*Sorghum*—The gene was upregulated in response to *Fusarium verticillioides* (Fv) in roots at early infection stages (6 and 24 hours post infection—hpi).

Wheat—The Wheat ortholog was upregulated in the roots of resistant genotypes in response to Fv at early infection stages (6 hpi) and in all genotypes at 24 dpi. In addition, the gene was upregulated in inflorescences in response to Fg both at early and late infection stages (30 and 50 hpi).

Maize—The Maize ortholog was upregulated in the roots in response to Fv at late infection stage (6 and 14 days post infection—dpi). An upregulation in the inflorescences was detected in response to Fv infection (3 dpi). Also, an upregulation in the roots was detected following *Fusarium graminearum* (Fg) infection (3 dpi). In addition, the gene was upregulated in the pith and cortex tissues following stalk injection of *Colletotrichum graminicola* (Cg) spores, and was upregulated in the inflorescence in response to Cg infection (4 and 6 dpi). Barley—The gene was upregulated mainly at early, but also at late stages following inflorescence infection with Fg (2, 3, 4 and 6 dpi) or challenging assays with the mycotoxin Deoxynivalenol (DON) (12 and 24 hpi).

*Brachypodium*—The *Brachypodium* ortholog gene was upregulated following spikes inoculation with Fg (96 hpi).

LFS55

Expression based indications for *Fusarium* or *Colletotrichum* resistance:

*Sorghum*—The gene was upregulated in the roots in response to *Fusarium* verticillioides (Fv) at both early and late infection stages (6 and 24 hours post infection—hpi, 15 days post infection—dpi, respectively). Injection of Fv spores to the stalk induced upregulation of the gene in the pith both at early and late infection stages (3 and 7 dpi).

Maize—The Maize ortholog was upregulated mainly in the roots of resistant genotypes in response to Fv at early infection stages (6 hpi). The ortholog was also upregulated in inflorescences in response to Fv at early infection stage (3 dpi). As well, an upregulation in the roots was detected following *Fusarium graminearum* (Fg) infection (1 and 3 dpi). In addition, the ortholog was upregulated in the inflorescence in response to *Colletotrichum graminicola* (Cg) at late infection stage (6 dpi).

Wheat—The Wheat ortholog was upregulated in the roots of resistant genotypes in response to Fv at early infection stages (6 hpi). Also, the gene was upregulated mainly at the inflorescences of resistant genotypes in response to Fg at both early and late infection stages (30 and 50 hpi).

Barley—The gene was upregulated mainly at early, but also at late stages following inflorescence infection with *Fusarium graminearum* (Fg) (48, 72, 96 and 144 hpi) or challenging assays with the mycotoxin Deoxynivalenol (DON) (12 and 24 hours post infection—hpi).

*Brachypodium*—The *Brachypodium* ortholog gene was upregulated following spikes inoculation with Fg (96 hpi).

LFS57

Expression based indications for *Fusarium* or *Colletotrichum* resistance:

*Sorghum*—The gene was upregulated in the roots in response to *Fusarium* verticillioides (Fv) at early infection stages (6 and 24 hours post infection—hpi).

Barley—The gene was upregulated mainly at early, but also at late stages following inflorescence infection with Fg (2, 3, 4 and 6 days post infection—dpi) or challenging assays with the mycotoxin Deoxynivalenol (DON) (12 and 24 hpi).

Wheat—The Wheat ortholog was upregulated in the roots of resistant genotypes in response to (Fv) at early infection stages (6 hours post infection—hpi). In addition, the gene was upregulated in the inflorescence of wheat in response to (Fg) at early and late infection stages (30 and 50 hpi).

*Brachypodium*—The *Brachypodium* ortholog gene was upregulated following spikes inoculation with Fg (96 hpi).

LFS6

Expression based indications for *Fusarium* or *Colletotrichum* resistance:

Barley—The gene was upregulated mainly at early, but also at late stages following inflorescence infection with *Fusarium graminearum* (Fg) (3 and 4 days post infection—dpi) or challenging assays with the mycotoxin Deoxynivalenol (DON) (12 and 24 hours post infection—hpi).

Maize—The Maize ortholog was upregulated in roots of resistant genotypes in response to *Fusarium verticillioides* (Fv) at late infection stages (6 and 14 dpi). The ortholog was also upregulated in inflorescences of resistant genotypes in response to Fv at early infection stages (3 and 4 dpi). As well, an upregulation was observed in the roots of mainly resistant genotypes in response to Fg at early infection stages (1 and 3 dpi). Following stalk injection of *Colletotrichum graminicola* (Cg) spores, the ortholog was upregulated in the pith of resistant genotypes at late infection stages (7 dpi) Similarly, an upregulation of the ortholog was found in the inflorescence tissue in response to infection with a Cg b-glucan overexpressing strain (6 dpi).

*Sorghum*—The *Sorghum* ortholog was upregulated in the roots of all genotypes or mainly in resistant genotypes in response to Fv at early infection stages (6 and 24 hpi, respectively).

Wheat—The Wheat ortholog was upregulated in roots of resistant genotypes in response to *Fusarium verticillioides* (Fv) at early infection stages (6 hpi). In addition, the gene is upregulated in inflorescences in response to *Fusarium graminearum* (Fg) at both early and late infection stages (30, 50 and 96 hpi).

LFS60

Expression based indications for *Fusarium* or *Colletotrichum* resistance:

*Sorghum*—The gene was upregulated in response to *Fusarium verticillioides* (Fv) in roots at early infection stages (6 and 24 hours post infection—hpi). At late stages, the gene was upregulated in resistant genotypes in response to Fv infection (15 days post infection—dpi).

Wheat—The Wheat ortholog was upregulated in the roots in response to Fv both at early and late infection stages (6 and 24 hpi, 5 days post infection—dpi, respectively). In addition, an upregulation of the gene following *Fusarium graminearum* (Fg) was detected in the roots (3 dpi).

Maize—The Maize ortholog was upregulated in the inflorescences in response to Fv infection (3 dpi). Injection of Fv spores to the stalk induced upregulation of the gene at late infection stage (7 dpi). As well, an upregulation in the roots was detected following Fg infection (3 dpi). In addition, the gene was upregulated in the pith following stalk injection of *Colletotrichum graminicola* (Cg) spores (3 and 7 dpi).

LFS61

Expression based indications for *Fusarium* or *Colletotrichum* resistance:

*Sorghum*—The gene was upregulated in the roots in response to *Fusarium* verticillioides (Fv) both at early infection stages (6 and 24 hours post infection—hpi, 5 days post infection, respectively). At late Fv infection stage an upregulation was detected in the stem (5 dpi). Injection of Fv spores to the stalk induced an upregulation of the gene both at early and late infection stages (3 and 7 dpi).

Maize—The Maize ortholog was upregulated in the roots in response to Fv at early infection stage (6 and 24 hpi). The ortholog was also upregulated in the inflorescence in response to Fv (3 and 4 dpi). Also, an upregulation in the roots was detected following *Fusarium graminearum* (Fg) infection (1 and 3 dpi). In addition, the gene was upregulated in the pith following stalk injection of *Colletotrichum graminicola* (Cg) both at early and late infection stages (3 and 7 dpi), and was upregulated in the Maize inflorescence in response to Cg infection (6 dpi).

LFS62

Expression based indications for *Fusarium* or *Colletotrichum* resistance:

*Sorghum*—The gene was upregulated in the roots in response to *Fusarium* verticillioides (Fv) at early infection stages (6 and 24 hours post infection—hpi).

Wheat—The Wheat ortholog was upregulated in the roots of resistant genotypes in response to Fv at early infection stages (6 hpi). The gene was also upregulated mainly in the inflorescence of resistant genotypes in response to Fg at both early and late infection stages (30 and 50 hpi. 2 and 4 days post infection—dpi).

Maize—The Maize ortholog was upregulated in the roots of resistant genotypes in response to Fv at both early and late infection stages (6 and 24 hpi. 6 and 14 dpi). The ortholog was also upregulated in Maize inflorescence in response to Fv at early infection stage (3 dpi). In addition, the ortholog was upregulated in the inflorescence in response to *Colletotrichum graminicola* (Cg) at late infection stage (6 dpi). Barley—The gene was upregulated mainly at early but also at late stages following inflorescence infection with *Fusarium graminearum* (Fg) or challenging assays with the mycotoxin Deoxynivalenol (DON) (12, 24, 48, 72, 96 and 144 hours post infection—hpi).

LFS65

Expression based indications for *Fusarium* or *Colletotrichum* resistance:

*Sorghum*—The gene was upregulated in the roots in response to *Fusarium* verticillioides (Fv) at early infection stages (6 and 24 hours post infection—hpi).

Wheat—The Wheat ortholog was upregulated in the roots of resistant genotypes (6 hpi) and in all genotypes (24 hpi) in response to Fv at early infection stages. In addition, the gene was upregulated in the roots in response to *Fusarium graminearum* (Fg) at early infection stages (30 and 50 hpi).

Maize—The Maize ortholog was upregulated in the roots of resistant genotypes in response to Fv at early infection stages (6 hpi). In addition, the ortholog was upregulated in Maize inflorescence in response to Fv at early infection stage (3 days post infection—dpi). The ortholog was also upregulated in the inflorescence in response to *Colletotrichum graminicola* (Cg) at late infection stage (6 dpi). *Brachypodium*—The *Brachypodium* ortholog gene was upregulated following spikes inoculation with Fg (96 hpi).

Barley—The gene was upregulated mainly at early but also at late stages following inflorescence infection with Fg or challenging assays with the mycotoxin Deoxynivalenol (DON) (12, 24, 48 and 72 hours post infection—hpi).

LFS66

Maize—Injection of *Fusarium verticillioides* (Fv) spores to the stalk resulted in upregulation of the gene in both pith and cortex tissues of resistant genotypes mainly, at early and late infection stage (3 and 7 days post infection—dpi). An upregulation was observed as well at late infection stage in the roots and stem of resistant genotypes following Fv inoculation (14 dpi). The gene was upregulated in inflorescences in response to Fv at early infection stage (3 dpi). The gene was also upregulated in the roots in response to *Fusarium graminearum* (Fg) (1 and 3 dpi). In addition, the gene was upregulated in both pith and cortex following stalk injection of *Colletotrichum* graminicola (Cg) at late infection stages (3 and 7 dpi), and was upregulated in the Maize inflorescence in response to Cg infection (4 and 6 dpi).

*Sorghum*—The *Sorghum* ortholog was upregulated in the roots in response to Fv at early infection stages (6 and 24 hours post infection—hpi). In addition, injection of Fv spores to the *Sorghum* stalk resulted in upregulation of the gene in the pith tissue mainly at 3 dpi but also at 7 dpi. At late Fv infections stages, the ortholog was upregulated in the roots of resistant genotypes (5 dpi).

LFS67

Expression based indications for *Fusarium* or *Colletotrichum* resistance:

Wheat—The gene was upregulated in the roots of mainly resistant genotypes in response to *Fusarium verticillioides* (Fv) at early infection stages (3 and 10 days post infection—dpi). In addition, the gene was upregulated in inflorescences in response to *Fusarium graminearum* (Fg) at late infection stages (50 hours post infection—hpi).

Barley—The Barley ortholog was upregulated at late stages following inflorescence infection with Fg (3, 4 and 6 dpi). *Brachypodium*—The *Brachypodium* ortholog was upregulated following spikes inoculation with Fg (96 hpi). Maize—The Maize ortholog was upregulated in the roots of resistant genotypes in response to Fv at late infection stages (14 dpi). The ortholog was also upregulated in inflorescences in response to Fv at early infection stage (3 dpi). In addition, injection of *Colletotrichum graminicola* (Cg) spores to the stalk resulted in upregulation of the gene in the pith and cortex tissues at late infection stage (7 dpi).

LFS68

Expression based indications for *Fusarium* or *Colletotrichum* resistance:

Wheat—The gene was upregulated in the roots of resistant genotypes in response to *Fusarium verticillioides* (Fv) at early infection stages (6 and 24 hours post infection—hpi). In addition, the gene was upregulated in the roots and in the inflorescences in response to (Fg) infection (3 days post infection—dpi and 50 hpi, respectively).

*Sorghum*—The *Sorghum* ortholog was upregulated in the roots in response to Fv at both at early and late infection stages (6 and 24 hpi, 5 and 15 dpi, respectively).

Maize—The Maize ortholog was upregulated in the roots in response to Fv at late infection stages (6 and 14 dpi). The gene was also upregulated in the roots in response to Fg infection (3 dpi). Also, an upregulation of the ortholog was found in inflorescences in response to *Colletotrichum graminicola* (Cg) infection (6 dpi). *Brachypodium*—The *Brachypodium* ortholog gene was upregulated following spikes inoculation with Fg (96 hpi).

LFS7

Expression based indications for *Fusarium* or *Colletotrichum* resistance:

*Sorghum*—The gene was upregulated in response to *Fusarium verticillioides* (Fv) in roots at early infection stages (6 and 24 hours post infection—hpi).

Wheat—The Wheat ortholog was upregulated in the roots of resistant genotypes in response to Fv at early infection stages (6 hpi) and in all genotypes at 24 dpi. In addition, the gene was upregulated in inflorescences in response to Fg both at early and late infection stages (30 and 50 hpi).

Maize—The Maize ortholog was upregulated in the roots in response to Fv at late infection stage (6 and 14 days post infection—dpi). An upregulation in the inflorescences was detected in response to Fv infection (3 dpi). Also, an upregulation in the roots was detected following *Fusarium graminearum* (Fg) infection (3 dpi). In addition, the gene was upregulated in the pith and cortex tissues following stalk injection of *Colletotrichum graminicola* (Cg) spores, and was upregulated in the inflorescence in response to Cg infection (4 and 6 dpi).

Barley—The gene was upregulated mainly at early but also at late stages following inflorescence infection with Fg (2, 3, 4 and 6 dpi) or challenging assays with the mycotoxin Deoxynivalenol (DON) (12 and 24 hpi).

*Brachypodium*—The *Brachypodium* ortholog gene was upregulated following spikes inoculation with Fg (96 hpi).

LFS70

Expression based indications for *Fusarium* or *Colletotrichum* resistance:

Wheat—The Wheat ortholog was upregulated in the roots of resistant genotypes in response to *Fusarium verticillioides* (Fv) at early infection stages (6 hours post infection—hpi). In addition, the gene was upregulated in the inflorescence of wheat in response to *Fusarium graminearum* (Fg) both at early and late infection stages (30 and 50 hpi).

Barley—The gene was upregulated mainly at early but also at late stages following inflorescence infection with Fg (2, 3, 4 and 6 dpi) or challenging assays with the mycotoxin Deoxynivalenol (DON) (12 and 24 hpi).

LFS72

Expression based indications for *Fusarium* or *Colletotrichum* resistance:

Wheat—The gene was upregulated in the roots of resistant genotypes in response to *Fusarium verticillioides* (Fv) at early infection stages (6 hours post infection—hpi). In addition, the gene was upregulated in inflorescences in response to *Fusarium* graminearum (Fg) at late infection stages (50 hpi).

Barley—The gene was upregulated at early stages following challenging assays with the mycotoxin Deoxynivalenol (DON) (12 and 24 hpi).

*Brachypodium*—The *Brachypodium* ortholog was upregulated following spikes inoculation with Fg (96 hpi).

*Sorghum*—The *Sorghum* ortholog was upregulated in the roots in response to Fv at early infection stages (6 and 24 hpi).

LFS73

Expression based indications for *Fusarium* or *Colletotrichum* resistance:

Wheat—The gene is upregulated in the roots of resistant genotypes in response to *Fusarium verticillioides* (Fv) at early infection stages (6 hours post infection—hpi). In addition, the gene is upregulated in Wheat's inflorescence in response to *Fusarium* graminearum (Fg) at early infection stages (30 and 50 hpi). *Sorghum*—The *Sorghum* ortholog is upregulated in the roots in response to Fv at early infection stages (6 and 24 hpi).

Maize—The Maize ortholog is upregulated in the roots of resistant genotypes in response to Fv at early infection stages (6 hpi). In addition, the ortholog is upregulated in inflorescences in response to Fv at early infection stage (3 dpi). The ortholog as well is upregulated in the roots in response to Fg (3 dpi). The ortholog is also upregulated in both pith and cortex following stalk injection of *Colletotrichum graminicola* (Cg) at late infection stages (7 dpi). As well an upregulation of the ortholog is found in Maize's inflorescence in response to Cg infection (6 dpi).

LFS74

Expression based indications for *Fusarium* or *Colletotrichum* resistance:

Wheat—The gene was upregulated in the roots of resistant genotypes in response to *Fusarium verticillioides* (Fv) at early infection stages (6 and 24 hours post infection—hpi). In addition, the gene was upregulated in Wheat's inflorescence in response to *Fusarium graminearum* (Fg) at early and late infection stages (30 and 50 hpi, 2 and 4 days post infection—dpi, respectively).

*Sorghum*—The *Sorghum* ortholog was upregulated in the roots in response to Fv at early infection stages (6 and 24 hpi). In addition, an upregulation was observed in the roots of resistant genotypes in response to Fv at late infection stages (5 dpi). Injection of Fv spores to the stalk resulted in upregulation in the pith tissue at early and late infection stages (3 and 7 dpi). Maize—The Maize ortholog was upregulated in the inflorescence tissue in response to Fv at early infection stage (3 dpi). As well an upregulation of the ortholog was found in Maize's inflorescence in response to *Colletotrichum graminicola* (Cg) infection (6 dpi).

Barley—The Barley ortholog gene was upregulated at late stages following inflorescence infection with Fg (3, 4 and 6 dpi). *Brachypodium*—The *Brachypodium* ortholog gene was upregulated following spikes inoculation with Fg (96 hpi).

LFS75

Expression based indications for *Fusarium* or *Colletotrichum* resistance:

Wheat—The gene was upregulated in the roots of resistant genotypes in response to *Fusarium verticillioides* (Fv) at early infection stages (6 and 24 hours post infection—hpi). In addition, the gene was upregulated in the inflorescence in response to *Fusarium* graminearum (Fg) infection (50 hpi).

*Sorghum*—The *Sorghum* ortholog was upregulated in the roots in response to Fv both at early and late infection stages (6 and 24 hpi, 5 and 15 days post infection—dpi, respectively). In addition, injection of Fv spores to the stalk induced upregulation of the gene in the pith (3 and 7 dpi).

Maize—The Maize ortholog was upregulated in the roots in response to Fv at late infection stages (6 and 14 dpi). Injection of Fv spores to the stalk resulted in upregulation of the gene in the pith tissue at late infection stage (7 dpi). In addition, the gene was upregulated in Maize inflorescence in response to Fv at early infection stage (3 and 4 days post infection—dpi). The gene was also upregulated in the roots in response to Fg infection (3 dpi). The gene was upregulated in the pith following stalk injection of *Colletotrichum graminicola* (Cg) at late infection stages (7 dpi), and was upregulated in the Maize inflorescence in response to Cg infection (6 dpi).

*Brachypodium*—The *Brachypodium* ortholog gene was upregulated following spikes inoculation with Fg (96 hpi).

LFS76

Expression based indications for *Fusarium* or *Colletotrichum* resistance:

Wheat—The gene was upregulated in the roots of mainly resistant genotypes in response to *Fusarium verticillioides* (Fv) at both early and late infection stages (6 hours post infection—hpi, 5 and 10 days post infection—dpi, respectively). In addition, the gene was upregulated in inflorescences in response to *Fusarium graminearum* (Fg) at late infection stages (50 hours post infection—hpi).

Barley—The gene was upregulated at both early and late stages following inflorescence infection with *Fusarium graminearum* (Fg) (3, 4 and 6 dpi) or challenging assays with the mycotoxin Deoxynivalenol (DON) (12 and 24 hpi).

*Brachypodium*—The *Brachypodium* ortholog was upregulated following spikes inoculation with Fg (96 hpi).

*Sorghum*—The *Sorghum* ortholog was upregulated in the roots of resistant genotypes in response to Fv at early infection stages (24 hpi).

LFS77

Expression based indications for *Fusarium* or *Colletotrichum* resistance:

Wheat—The gene was upregulated in the roots of more resistant lines at early infection stages (6 hours post infection—hpi) and in all genotypes (24 hpi) in response to *Fusarium verticillioides* (Fv) infection. In addition, the gene was upregulated in the inflorescences in response to *Fusarium graminearum* (Fg) at later infection stages (50 hpi).

Barley—The gene was upregulated mainly at early but also at late stages following inflorescence infection with Fg (2, 3, 4 and 6 dpi) or challenging assays with the mycotoxin Deoxynivalenol (DON) (12 and 24 hpi).

*Brachypodium*—The *Brachypodium* ortholog gene was upregulated following spikes inoculation with Fg (96 hpi). Maize—The ortholog gene was upregulated mainly in the roots of resistant genotypes in response to *Fusarium verticillioides* (Fv) both at early and late infection stages (6 hpi, 6 and 14 dpi, respectively). In addition, the gene was upregulated in the inflorescences in response to Fv at early infection stage (3 dpi). The gene was also upregulated in the roots in response to *Fusarium graminearum* (Fg) (3 dpi). In addition, the gene was upregulated in the inflorescence following *Colletotrichum graminicola* (Cg) at late infection stages (6 dpi).

*Sorghum*—The *Sorghum* ortholog was upregulated in the roots in response to Fv at early infection stages (6 and 24 hpi).

LFS78

Wheat—The gene was upregulated mainly in inflorescences of resistant genotype in response to *Fusarium graminearum* (Fg) at late infection stages (50 hours post infection—hpi, 2 and 4 days post infection—dpi). In addition, an upregulation of the gene was detected in the stem following *Fusarium* pseudograminearum infection.

Barley—The gene was upregulated at both early and late stages following inflorescence infection with Fg (4 and 6 dpi) or challenging assays with the mycotoxin Deoxynivalenol (DON) (12, 24 and 48 hpi).

LFS79

Expression based indications for *Fusarium* or *Colletotrichum* resistance:

Barley—The gene was upregulated at both early and late stages following inflorescence infection with *Fusarium graminearum* (Fg) or challenging assays with the mycotoxin Deoxynivalenol (DON) (1, 2, 3, 4 and 6 days post infection—dpi).

Maize—The Maize ortholog was upregulated mainly in the roots of resistant genotypes in response to *Fusarium verticillioides* (Fv) both at early and late infection stages (6 hours post infection—hpi, 6 and 14 dpi). The ortholog was upregulated as well in inflorescences of resistant genotypes in response to Fv at early infection stages (3 dpi). An upregulation was also observed in the roots in response to Fg at late infection stages (3 dpi). A minor upregulation of the ortholog was found in the inflorescence tissue in response to infection with a Cg beta-glucan overexpressing strain (6 dpi).

*Sorghum*—The *Sorghum* ortholog was upregulated in the roots in response to *Fusarium* verticillioides (Fv) at early infection stages (6 hpi).

Wheat—The Wheat ortholog was upregulated in the roots of resistant genotypes in response to Fv at early infection stages (6 hpi). In addition, the ortholog was upregulated in response to Fg infection at early stages (inflorescence, 30 and 50 hpi).

LFS8

Expression based indications for *Fusarium* or *Colletotrichum* resistance:

Barley—The gene was upregulated mainly at late stages following inflorescence infection with *Fusarium graminearum* (Fg) (4 and 6 days post infection—dpi)

Maize—The Maize ortholog was upregulated in the roots in response to *Fusarium* verticillioides (Fv) at late infection stages (14 dpi). Injection of Fv spores to the stalk induced upregulation in the pith and cortex tissues at both early and late infection stages (3 and 7 dpi). The ortholog was upregulated as well in inflorescences in response to Fv infection (3 and 4 dpi). A late response was also observed in the roots in response to Fg infection (3 dpi). Injection of *Colletotrichum graminicola* (Cg) spores to the stalk induced upregulation of the gene in the pith and cortex tissues at late infection stage (7 dpi). Upregulation at late infection stage was also observed in the inflorescence following Cg infection (4 and 6 dpi).

*Sorghum*—The *Sorghum* ortholog was upregulated in the roots in response to Fv at early infection stages (24 hpi). A late response was observed in the stem following infection (5 dpi). Injection of Fv spores to the stalk induced upregulation in the pith at both early and late infection stages (3 and 7 dpi) while in the cortex a response was detected at late infection stage only (7 dpi).

Wheat—The Wheat ortholog was upregulated in the roots in response to Fv at early infection stages (24 hpi). In addition, the ortholog was upregulated in the inflorescence in response to Fg infection (50 hpi).

*Brachypodium*—The *Brachypodium* ortholog gene was upregulated following spikes inoculation with Fg (96 hpi).

LFS80

Expression based indications for *Fusarium* or *Colletotrichum* resistance:

Maize—The gene was upregulated in the roots in response to *Fusarium verticillioides* (Fv) both at early and late infection stages (6 and 24 hours post infection—hpi and 14 dpi respectively). The gene was also upregulated in the roots in response to *Fusarium* graminearum (Fg) (1 and 3 dpi). In addition, the gene was upregulated in Maize inflorescences in response to Fv at early infection stage (3 days post infection—dpi). Injection of Fv spores to the stalk resulted in upregulation of the gene in the pith and cortex tissues at late infection stage (7 dpi). In addition, the gene was upregulated in the pith and cortex tissues following stalk injection of *Colletotrichum graminicola* (Cg) spores at late infection stages (7 dpi), and was upregulated in the inflorescence in response to Cg infection (6 dpi).

Wheat—The Wheat ortholog was upregulated in the roots of resistant genotypes in response to Fv at early infection stages (6 and 24 hpi). In addition, the gene ortholog was upregulated in inflorescences in response to Fg at early infection stages (30 and 50 hpi). Barley—The gene was upregulated mainly at early but also at late stages following inflorescence infection with Fg (2, 3, 4 and 6 dpi) or challenging assays with the mycotoxin Deoxynivalenol (DON) (12 and 24 hpi). *Sorghum*—The *Sorghum* ortholog was upregulated in the roots in response to Fv at early infection stages (6 and 24 hpi). At late infection stage the gene was upregulated in the roots of resistant genotypes (5 dpi).

LFS9

Expression based indications for *Fusarium* or *Colletotrichum* resistance:

Barley—The gene was upregulated at both early and late stages following inflorescence infection with *Fusarium graminearum* (Fg) (3 and 4 days post infection—dpi) or challenging assays with the mycotoxin Deoxynivalenol (DON) (12 and 24 hours post infection—hpi).

Maize—The Maize ortholog was upregulated in inflorescences of resistant genotypes in response to *Fusarium verticillioides* (Fv) infection (3 dpi).

Rice—The Rice ortholog was upregulated in response to salicylic acid treatment (3 hpi).

*Sorghum*—The *Sorghum* ortholog was upregulated in the roots in response Fv at early infection stages (6 and 24 hpi). Injection of Fv spores to the stalk induced an upregulation of the gene in the pith both at early and late infection stages (3 and 7 dpi).

Wheat—The Wheat ortholog was upregulated in the roots in response to Fv at early infection stages (6 and 24 hpi). In addition, the ortholog was upregulated in the inflorescences in response to Fg infection 50 hpi).

LFS71

Expression based indications for *Fusarium* or *Colletotrichum* resistance:

Wheat—The gene was upregulated in the in response to *Fusarium verticillioides* (Fv) at both early and late infection stages (6 and 24 hours post infection—hpi, 10 days post infection—dpi, respectively). In addition, the gene was upregulated mainly in the roots of resistant genotypes in response to *Fusarium graminearum* (Fg) at early infection stage (24 hpi), and was upregulated in the inflorescences at late infection stages (50 hpi).

*Sorghum*—The *Sorghum* ortholog was upregulated in the roots in response to Fv both at early and late infection stages (6 and 24 hpi, 5 dpi, respectively). Injection of Fv spores to the stalk induced an upregulation of the gene in the pith both at early and late infection stages (3 and 7 dpi).

Maize—The gene was upregulated in the inflorescences in response both to Fv at early infection stage (3 dpi) and *Colletotrichum graminicola* (Cg) at late infection stages (6 dpi).

*Brachypodium*—The *Brachypodium* ortholog gene was upregulated following spikes inoculation with Fg (96 hpi).

LFS29

Expression based indications for *Fusarium* or *Colletotrichum* resistance:

Maize—The gene was upregulated in the roots of resistant genotypes in response to *Fusarium verticillioides* (Fv) at early infection stages (6 hours post infection—hpi) and a relatively higher upregulation was observed at late infection stages (6 and 14 days post infection—dpi). Injection of Fv spores to the stalk resulted in upregulation of the gene at late stages in both pith and cortex tissues (7 dpi). In addition, the gene was upregulated in the resistant Maize genotype in response to inflorescence infection with Fv, at early stages (4 dpi). Also, the gene was upregulated in the roots in response to *Fusarium* graminearum (Fg) (1 and 3 dpi). In addition, the gene was upregulated in the cortex (3 dpi) and in the pith (7 dpi) following stalk injection of *Colletotrichum graminicola* (Cg) spores, and was upregulated in the inflorescence in response to Cg infection (4 and 6 dpi).

*Sorghum*—The *Sorghum* ortholog was upregulated in the roots in response to Fv at early infection stages (6 and 24 hpi). In addition, upregulation was observed in the roots of resistant genotypes at late infection stage (6 dpi). At 15 dpi, resistant genotypes presented higher basal level of the gene. Injection of Fv spores to the stalk resulted in upregulation of the gene in the pith at 3 and 7 dpi.

LFS19

Expression based indications for *Fusarium* or *Colletotrichum* resistance:

Maize: The gene was upregulated in the roots of resistant genotypes in response to *Fusarium verticillioides* (Fv) at early infection stages (1.5 hours post infection). A relatively higher upregulation in response to Fv infection was observed in the roots and stems at late infection stages (14 days post infection—14 dpi). In addition, the gene was upregulated in Maize inflorescence in response to Fv at early infection stage (4 dpi). The gene was also upregulated in the roots of mainly resistant genotypes in response to *Fusarium graminearum* (Fg) (1 and 3 dpi). Also, the gene was upregulated in the Maize inflorescence in response to Cg infection (4 and 6 dpi).

Tables 7-10 summarize the identity of core genes identified in *sorghum*, maize, wheat and barley (respectively) and their orthologs, based on the transcriptoms and differential expression analyses described hereinabove. "x" denotes expression of the gene associated with the indicated fungi at the indicated plant part. The orthologs are identified by the SEQ ID NO. of the encoded protein.

Table 7 hereinbelow presents core genes revealed in *Sorghum* and related orthologs in Maize and Barley in different organs of the plants after challenge with *F. verticilloides, F. graminearum* or *C. graminicola*. Cells marked by "x" denote genes associated with *Fusarium* verticilloides (Fv) or *Fusarium graminearum* (Fg) infection revealed in stem or root of *Sorghum*. Numbers within cells are SEQ ID NOs. of proteins encoded by orthologs of the genes revealed in *Sorghum* identified in maize and barley.

TABLE 7

Expression atlas of *Sorghum* selected genes and related orthologs

| | *Sorghum* | | | | Maize | | | | | | Barley |
|---|---|---|---|---|---|---|---|---|---|---|---|
| | Organ | | | | | | | | | | |
| | Stem | | Root | | Inflor. | | | Root | | | Inflor. |
| | Fungus | | | | | | | | | | |
| Gene name | Fg | Fv | Fg | Fv | Cg | Fg | Fv | Cg | Fg | Fv | Fg |
| LFS45 | | x | | x | | | | | | | |
| LFS46 | | | | x | | | | | 820, 818 | 820, 818 | |
| LFS47 | | x | | x | | | | | | | |
| LFS48 | | | | x | | | | 937 | 937 | 937 | |
| LFS49 | | | | x | | | | | | | |

TABLE 7-continued

Expression atlas of *Sorghum* selected genes and related orthologs

| | *Sorghum* | | | | Maize | | | | | | Barley |
|---|---|---|---|---|---|---|---|---|---|---|---|
| | Organ | | | | | | | | | | |
| | Stem | | Root | | Inflor. | | | Root | | | Inflor. |
| | Fungus | | | | | | | | | | |
| Gene name | Fg | Fv | Fg | Fv | Cg | Fg | Fv | Cg | Fg | Fv | Fg |
| LFS50 | | | | x | 822 | | | 822 | 822 | 822 | |
| LFS51 | | x | | x | | | | | | | |
| LFS52 | | | | x | 840 | 840 | | 840 | 840 | 840 | |
| LFS53 | | x | | x | | | 842 | 842 | | 842 | |
| LFS54 | | | | x | 845 | | | 845 | 845 | 845 | 844 |
| LFS55 | | x | | x | | | 926 | 926 | 926 | 926 | |
| LFS59 | | x | | x | | | | | | | |
| LFS57 | | | | x | | | | | | | |
| LFS58 | | x | | x | | | | | | | |
| LFS60 | | | | x | | | | | | | |
| LFS61 | | x | | x | | | 855 | | 855 | | |
| LFS62 | | | | x | | | | | | | |
| LFS65 | | | | x | | | | | | | |
| LFS66 | | x | | x | | | | | | | |

"Fv" = *Fusarium verticilloides*;
"Fg" = *Fusarium graminearum*;
"Cg" = *Colletotrichum graminicola*

Table 8 hereinbelow presents core genes revealed in Maize and related orthologs in *Sorghum* and Wheat in different organs of the plants after challenge with *F. verticilloides, F. graminearum* or *C. graminicola*. Cells marked by "x" denote genes associated with *Fusarium* verticilloides (Fv), *Fusarium graminearum* (Fg) or *Colletotrichum graminicola* (Cg) infection revealed in stem, inflorescence or root of Maize. Numbers within cells are SEQ ID NOs. of proteins encoded by orthologs of the genes revealed in Maize identified in *Sorghum* and Wheat.

TABLE 8

Expression atlas of Maize selected genes and related orthologs

| | Maize | | | | | | | | *Sorghum* | | | Wheat | | |
|---|---|---|---|---|---|---|---|---|---|---|---|---|---|---|
| | Organ | | | | | | | | | | | | | |
| | Stem | | | Inflor | | | Root | | Stem | Root | | Inflor | Root | |
| | Fungus | | | | | | | | | | | | | |
| Gene name | Fg | Fv | Cg | Fg | Fv | Cg | Fg | Fv | Fv | Fg | Fv | Fg | Fg | Fv |
| LFS11 | | | | | x | | x | x | | | 690 | | | |
| LFS13 | | x | | | x | | x | x | | | | | | |
| LFS14 | | x | x | | | | x | x | | | | | | |
| LFS15 | | | | | x | x | | x | | | | | | |
| LFS16 | | | x | | x | x | | | 695 | | 695 | | | |
| LFS17 | | | x | | x | | | x | | | | | | |
| LFS18 | | | x | | x | x | x | x | 919 | | 919 | | | |
| LFS19 | | x | | | | x | x | x | | | | | | |
| LFS21 | | | | | x | x | | x | | | | | | |
| LFS22 | | | x | | x | x | | x | | | 970 | | | |
| LFS24 | | x | x | | | x | x | x | 704 | | 704 | | | |
| LFS25 | | x | x | | x | x | x | x | | | | | | |
| LFS26 | | x | x | | | x | x | x | | | | | | |
| LFS27 | | | x | | x | x | | x | | | | | | |
| LFS28 | | x | | | | | x | x | | | 974 | | | |
| LFS29 | | x | x | | x | x | x | x | | | | | | |
| LFS30 | | x | | | | x | x | x | 729 | | 729 | | | |
| LFS31 | | x | x | | | x | | x | | | 731 | | | |
| LFS32 | | x | x | | x | x | x | x | | | | | | |
| LFS33 | | | | | x | x | x | x | | | | | | |
| LFS34 | | | x | | | x | x | x | | | | | | |
| LFS35 | | x | x | | | x | x | x | | | 740 | | | |
| LFS36 | | x | | | x | x | x | x | | | | | | |
| LFS37 | | | | | x | x | x | x | | | 755 | | | |
| LFS38 | | | x | | x | x | x | x | | | 782 | 789 | | 789 |
| LFS39 | | x | x | | x | x | | x | | | 792 | | | |
| LFS40 | | | | | | | x | x | | | 971 | | | |
| LFS42 | | | | | | | x | x | | | 795 | | | |
| LFS43 | | x | x | | x | | x | x | | | 798 | | | |
| LFS44 | | | x | | x | x | x | x | 804 | | 804 | | | |

TABLE 8-continued

Expression atlas of Maize selected genes and related orthologs

| | Maize | | | | | | | | *Sorghum* | | | Wheat | | |
|---|---|---|---|---|---|---|---|---|---|---|---|---|---|---|
| | Organ | | | | | | | | | | | | | |
| | Stem | | | Inflor | | | Root | | Stem | Root | | Inflor | Root | |
| | Fungus | | | | | | | | | | | | | |
| Gene name | Fg | Fv | Cg | Fg | Fv | Cg | Fg | Fv | Fv | Fg | Fv | Fg | Fg | Fv |
| LFS54 | | | x | | x | x | x | x | | | | 845 | | 845 |
| LFS80 | | x | x | | x | x | x | x | | | 910 | 915 | | 915 |

"Fv" = *Fusarium verticilloides*;
"Fg" = *Fusarium graminearum*:
"Cg" = *Colletotrichum graminicola*

Table 9 hereinbelow presents core genes revealed in Wheat and related orthologs in Maize and Barley in different organs of the plants after challenge with *F. verticilloides, F. graminearum* or *C. graminicola*. Cells marked by "x" denote genes associated with *Fusarium* verticilloides (Fv) or *Fusarium graminearum* (Fg) infection revealed in stem, inflorescence or root of Wheat. Numbers within cells are SEQ ID NOs. of proteins encoded by orthologs of the genes revealed in Wheat identified in maize and barley.

TABLE 9

Expression atlas of Wheat selected genes and related orthologs

| | Wheat | | | | | | Maize | | Barley |
|---|---|---|---|---|---|---|---|---|---|
| | Organ | | | | | | | | |
| | Stem | | Inflor. | | Root | | Inflor | | Inflor. |
| | Fungus | | | | | | | | |
| Gene name | Fg | Fv | Fg | Fv | Fg | Fv | Fv | Cg | Fg |
| LFS53 | | | x | | x | x | 842 | 842 | |
| LFS67 | | | | | x | x | | | 867 |
| LFS68 | | | x | | | x | | | |
| LFS70 | | | x | | | x | | | |
| LFS72 | | | x | | | x | | | |
| LFS73 | | | x | | | x | | | |
| LFS74 | | | x | | | x | | | 893 |
| LFS75 | | | x | | | x | | | |
| LFS76 | | | x | | | x | | | 898, 904 |
| LFS77 | | | x | | | x | | | |
| LFS78 | | | x | | | | | | |

"Fv" = *Fusarium verticilloides*;
"Fg" = *Fusarium graminearum*:
"Cg" = *Colletotrichum graminicola*

Table 10 hereinbelow presents core genes revealed in Barley and related orthologs in wheat in different organs of the plants after challenge with *F. verticilloides* or *F. graminearum*. Cells marked by "x" denote genes associated with *Fusarium* graminearum (Fg) infection revealed in inflorescence of Barley. Numbers within cells are SEQ ID NOs. of proteins encoded by orthologs of the genes revealed in Barley identified in Wheat.

TABLE 10

Expression atlas of Barley selected genes and related orthologs

| | Barley | Wheat | | |
|---|---|---|---|---|
| | Organ | | | |
| | Inflor. | Inflor. | Root | |
| | Fungus | | | |
| Gene name | Fg | Fg | Fg | Fv |
| LFS10 | x | | | 681 |
| LFS2 | x | 656, 658 | | |
| LFS3 | x | 661 | 661 | 661 |
| LFS4 | x | | | |
| LFS6 | x | 668, 670 | | 668, 670 |
| LFS7 | x | | | |
| LFS8 | x | 671, 672 | | 671, 672 |
| LFS9 | x | | | |
| LFS79 | x | 957 | | 957 |

Fg" = *Fusarium verticilloides*;
"Fv" = *Fusarium graminearum*:
"Cg" = *Colletotrichum graminicola*

Example 4: Identification of Domains Comprised within Identified Genes

A polypeptide domain refers to a set of conserved amino acids located at specific positions along an alignment of sequences of evolutionarily related proteins. While amino acids at other positions can vary between homologues, amino acids that are highly conserved, and particularly amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families Pfam is hosted at the Sanger Institute server in the United Kingdom.

Interpro is hosted at the European Bioinformatics Institute in the United Kingdom. InterProScan is the software package that allows sequences (protein and nucleic) to be scanned against InterPro's signatures. Signatures are predictive models, provided by several different databases that make up the InterPro consortium.

InterProScan 5.11-51.0 was used to analyze the polypeptides of the present invention (core and homologues/orthologs) for common domains (Mitchell A et al., 2015. Nucleic Acids Research 43(Database issue):D213-221; doi: 10.1093/nar/gku1243). Briefly, InterProScan is based on scanning methods native to the InterPro member databases. It is distributed with pre-configured method cut-offs recommended by the member database experts and which are believed to report relevant matches. All cut-offs are defined in configuration files of the InterProScan programs. Matches obtained with the fixed cut-off are subject to the following filtering:

Pfam filtering: Each Pfam family is represented by two hidden Markov models (HMMs)—ls and fs (full-length and fragment). An HMM model has bit score cut-offs (for each domain match and the total model match) and these are defined in the Gathering threshold (GA) lines of the Pfam database. Initial results are obtained with quite a high common cut-off and then the matches of the signature with a lower score than the family specific cut-offs are dropped.

If both the fs and ls model for a particular Pfam hits the same region of a sequence, the AM field in the Pfam database is used to determine which model should be chosen—globalfirst(LS); localfirst(FS) or byscore (whichever has the highest e-value).

Another type of filtering has been implemented since release 4.1. It is based on Clan filtering and nested domains. Further information on Clan filtering can be found in the Pfam website (http://www.sanger.ac.uk/Pfam) for more information on Clan filtering.

TIGRFAMs filtering: Each TIGRFAM HMM model has its own cut-off scores for each domain match and the total model match. These bit score cut-offs are defined in the "trusted cut-offs" (TC) lines of the database. Initial results are obtained with quite a high common cut-off and then the matches (of the signature or some of its domains) with a lower score compared to the family specific cut-offs are dropped.

PRINTS filtering: All matches with p-value more than a pre-set minimum value for the signature, are dropped.

SMART filtering: The publicly distributed version of InterProScan has a common e-value cut-off corresponding to the reference database size. A more sophisticated scoring model is used on the SMART web server and in the production of pre-calculated InterPro match data.

Exact scoring thresholds for domain assignments are proprietary data. The InterProMatches data production procedure uses these additional smart.thresholds data. It is to be noted that the given cut-offs are e-values (i.e. the number of expected random hits) and therefore are valid only in the context of reference database size and smart.desc data files to filter out results obtained with higher cut-off.

It implements the following logic: If the whole sequence E-value of a found match is worse than the 'cut_low', the match is dropped. If the domain E-value of a found match is worse than the 'repeat' cut-off (where defined) the match is dropped. If a signature is a repeat, the number of significant matches of that signature to a sequence must be greater than the value of 'repeats' in order for all matches to be accepted as true (T).

If the signature is part of a family ('family_cut' is defined), if the domain E-value is worse than the domain cut off ('cutoff'), the match is dropped. If the signature has "siblings" (because it has a family_cut defined), and they overlap, the preferred sibling is chosen as the true match according to information in the overlaps file.

PROSITE patterns CONFIRMation: ScanRegExp is able to verify PROSITE matches using corresponding statistically-significant CONFIRM patterns. The default status of the PROSITE matches is unknown (?) and the true positive (T) status is assigned if the corresponding CONFIRM patterns match as well. The CONFIRM patterns were generated based on the true positive SWISS-PROT PROSITE matches using eMOTIF software with a stringency of 10e-9 P-value.

PANTHER filtering: Panther has pre- and post-processing steps. The pre-processing step is intended to speed up the HMM-based searching of the sequence and involves blasting the HMM sequences with the query protein sequence in order to find the most similar models above a given e-value. The resulting HMM hits are then used in the HMM-based search.

Panther consists of families and sub-families. When a sequence is found to match a family in the blast run, the sub-families are also scored using HMMER tool (that is, unless there is only 1 sub-family, in which case, the family alone is scored against).

Any matches that score below the e-value cut-off are discarded. Any remaining matches are searched to find the HMM with the best score and e-value and the best hit is then reported (including any sub-family hit).

GENE3D filtering: Gene3D also employs post-processing of results by using a program called DomainFinder. This program takes the output from searching the Gene3D HMMs against the query sequence and extracts all hits that are more than 10 residues long and have an e-value better than 0.001. If hits overlap at all, the match with the better e-value is chosen.

The polypeptides of the invention the expression of which confers and/or enhances the resistance of a plant to at least one fungal pathogen can be characterized by specific amino acid domains According to certain embodiments, particular domains are conserved within a family of polypeptides as described in Table 11 hereinbelow. Without wishing to be bound by specific theory or mechanism of action, the conserved domain may indicate common functionally of the polypeptides comprising same. The domains are presented by an identifier (number). Table 12 provides the details of each domain.

TABLE 11

Core and homologous polypeptides comprising the same domains

| Core Polypeptide (SEQ ID NO) | Characteristic Domains (Domain identifier) | Homologous Polypeptides Comprising the Domains (SEQ ID NOs) |
|---|---|---|
| 571 | 1; 5; 2; 5; 4; 5; 2; 2; 2; 5; 2; 5; 2; 3; 5; 2; 5; 2; 2 | 655; 656; 657; 658 |
| 572 | 6; 6; 6; 6 | 659; 660; 661; 662; 663 |

TABLE 11-continued

| Core and homologous polypeptides comprising the same domains | | |
|---|---|---|
| Core Polypeptide (SEQ ID NO) | Characteristic Domains (Domain identifier) | Homologous Polypeptides Comprising the Domains (SEQ ID NOs) |
| 573 | 7 | 664; 665; 666 |
| 574 | 8; 8; 9 | 667; 668; 669; 670 |
| 575 | | |
| 576 | | |
| 577 | 10; 10; 10; 11; 11; 11; 10; 11; 10; 11; 10; 12; 10; 11 | 674; 675; 676; 677; 678; 679; 680 |
| 578 | 13 | 681; 682; 683; 684; 685; 686; 687; 688 |
| 579 | 14; 14; 15 | 689; 690; 691; 692; 693 |
| 580 | 16 | 694; 944; 945; 946; 947 |
| 581 | | |
| 582 | 17; 17; 17 | |
| 583 | 20; 18; 19 | 695; 696; 697; 698; 699 |
| 584 | 8; 8; 9 | |
| 585 | 8; 8; 9 | |
| 586 | 21 | |
| 587 | 22; 22 | |
| 588 | 23; 24; 24; 24; 24 | 700; 701; 702; 703 |
| 589 | 27; 27; 26; 29; 30; 27; 25; 30 | 704; 705; 706; 707 |
| 590 | 35; 32; 33; 33; 32; 31; 33; 36; 34; 32; 33; 32; 31; 36 | 708; 709; 710; 711; 712; 713; 714; 715; 716; 717; 718; 719; 720; 721; 722; 723; 724; 725; 726; 727 |
| 591 | 37; 37; 38; 38; 38; 38; 38; 38 | |
| 592 | | |
| 593 | 21 | 728 |
| 594 | 40; 40; 41 | 729; 730 |
| 595 | 7; 7 | 731; 732 |
| 596 | 43; 43; 42; 43; 43; 43; 43 | |
| 597 | 47; 37; 37; 47; 44; 45; 46; 45 | 733; 734; 735; 736 |
| 598 | 49; 50; 50; 50; 49; 48; 49; 48; 49; 49; 49; 48 | 737; 738; 739 |
| 599 | 51; 52; 52; 52; 53; 53; 53; 54 | 740; 741; 742 |
| 600 | 5; 1; 2; 5; 4; 5; 2; 2; 2; 5; 2; 5; 2; 3; 5; 2; 5; 2; 2 | 743; 744; 745; 746; 747; 748; 749; 750; 751; 752; 753; 754 |
| 601 | 59; 61; 61; 57; 62; 55; 58; 60; 64; 58; 60; 62; 62; 55; 62; 62; 63 | 755; 756; 757; 758; 759; 760; 761; 762; 763; 764; 765; 766; 767; 768; 769; 770; 771; 772; 773; 774; 775; 776; 777; 778; 779; 780; 781 |
| 602 | | |
| 603 | 65; 65; 65 | 790; 791; 792; 793; 794 |
| 604 | 45; 45; 66 | 795; 796; 797 |
| 605 | 10; 10; 10; 11; 11; 11; 11; 10; 11; 11; 10; 11; 11; 10; 12; 11 | 798; 799; 800; 801; 802; 803 |
| 606 | 6; 6; 6; 6 | 804; 805; 806; 807; 808 |
| 607 | 67 | 809 |
| 608 | 69; 70; 60; 60; 68; 70; 60 | 810; 811; 812; 813; 814; 815; 816; 817; 818; 819; 820 |
| 609 | 72; 71 | |
| 610 | 73 | |
| 611 | 7; 7 | 821; 822; 823; 824; 825; 826; 827; 828; 829; 830 |
| 612 | 74; 74; 74; 33; 32; 33; 32; 31; 75; 74; 74; 74; 33; 32; 33; 32; 31; 75 | 831; 832; 833; 834; 835; 836; 837; 838; 839 |
| 613 | 33; 33; 76 | 840; 841 |
| 614 | 40; 40; 77 | 842; 843 |
| 615 | 23; 24; 24; 24; 24 | 700; 701; 702; 703; 844; 845; 846; 847; 848 |
| 616 | 7; 7 | 849 |
| 617 | 78 | 850 |
| 618 | | |
| 619 | 74; 74; 74; 32; 33; 33; 32; 31; 75; 74; 74; 74; 33; 32; 33; 32; 31 | 852 |
| 620 | 42; 43; 43; 43; 43; 43 | 853 |
| 621 | 79 | 854; 855; 856; 857; 858; 859 |
| 622 | 7; 7 | 860; 861; 862; 863 |
| 623 | | |
| 624 | | |
| 625 | 49; 50; 50; 50; 49; 48; 49; 48; 49; 49; 49; 48 | 866; 867; 868; 869 |
| 626 | | |
| 627 | 80 | 627; 880; 881; 882; 883; 884 |
| 628 | 40; 40; 77 | 885; 886; 887 |
| 629 | 81 | 888 |
| 630 | 10; 10; 10; 11; 11; 10; 11; 11; 10; 11; 11; 10; 12; 10; 11 | 889 |
| 631 | | |
| 632 | 82 | 894 |

TABLE 11-continued

| Core and homologous polypeptides comprising the same domains | | |
|---|---|---|
| Core Polypeptide (SEQ ID NO) | Characteristic Domains (Domain identifier) | Homologous Polypeptides Comprising the Domains (SEQ ID NOs) |
| 633 | 7; 7 | 895; 896; 897; 898; 899; 900; 901; 902; 903; 904; 905; 906; 907; 908 |
| 634 | | |
| 635 | | |
| 636 | 84; 83; 84; 83; 84; 84; 84 | 910; 911; 912; 913; 914; 915; 916; 917; 918 |
| 639 | 8; 8; 9 | 919; 920; 921 |
| 643 | | |
| 644 | 10; 10; 10; 11; 11; 11; 11; 10; 11; 11; 10; 11; 11; 10; 12; 11 | 923 |
| 647 | 7; 7 | 924; 925; 926; 927; 928; 929 |
| 649 | | |
| 651 | 81 | 930 |
| 653 | 82 | 931; 932; 933 |
| 654 | | |
| 940 | 52; 52; 52; 52; 52 | 948; 949; 950; 969; 970 |
| 941 | 88; 89; 89; 89; 85; 85; 86; 86; 87 | 971; 972 |
| 942 | 52; 52; 52; 52; 52; 52; 52; 52 | 936; 937 |
| 943 | 52; 52; 52; 52; 52; 52; 52; 52 | 938; 939 |
| 965 | 20; 18; 18; 90; 92 | 951; 952; 953; 954; 973 |
| 966 | | |
| 967 | 93; 93; 93 | 955; 956; 957; 958; 959; 960; 961; 962; 963; 964; 975; 976; 977 |

TABLE 12

| Details of Identified Domains | | | |
|---|---|---|---|
| Domain Identifier | InterPro No. | Accession No. | Description |
| 1 | IPR010255 | SSF48113 | Haem peroxidase |
| 2 | IPR000823 | PR00461 | Plant peroxidase signature Plant peroxidase |
| 3 | IPR019793 | PS00435 | Peroxidases proximal heme-ligand signature. Peroxidases heam-ligand binding site |
| 4 | IPR019794 | PS00436 | Peroxidases active site signature. Peroxidase, active site |
| 5 | IPR002016 | PR00458 | Haem peroxidase superfamily signature Haem peroxidase, plant/fungal/bacterial |
| 6 | IPR002902 | PS51473 | Gnk2-homologous domain profile. Gnk2-homologous domain |
| 7 | IPR002213 | PS00375 | UDP-glycosyltransferases signature. UDP-glucuronosyl/UDP-glucosyltransferase |
| 8 | IPR010399 | PF06200 | tify domain Tify domain |
| 9 | IPR018467 | PF09425 | Divergent CCT motif CO/COL/TOC1, conserved site |
| 10 | IPR001128 | PR00385 | P450 superfamily signature Cytochrome P450 |
| 11 | IPR002401 | PR00463 | E-class P450 group I signature Cytochrome P450, E-class, group I |
| 12 | IPR017972 | PS00086 | Cytochrome P450 cysteine heme-iron ligand signature. Cytochrome P450, conserved site |
| 13 | IPR006904 | PF04819 | Family of unknown function (DUF716) Protein of unknown function DUF716 (TMEM45) |
| 14 | IPR020846 | PS50850 | Major facilitator superfamily (MFS) profile. Major facilitator superfamily domain |
| 15 | IPR011701 | PF07690 | Major Facilitator Superfamily Major facilitator superfamily |
| 16 | IPR022251 | PF12609 | Wound-induced protein Protein of unknown function wound-induced |
| 17 | IPR018392 | SM00257 | LysM domain |
| 18 | IPR000719 | PS50011 | Protein kinase domain profile. Protein kinase domain |
| 19 | IPR001245 | PF07714 | Protein tyrosine kinase Serine-threonine/tyrosine-protein kinase catalytic domain |
| 20 | IPR011009 | SSF56112 | Protein kinase-like domain |
| 21 | IPR008889 | PF05678 | VQ motif VQ |
| 22 | IPR006598 | SM00672 | Lipopolysaccharide-modifying protein |
| 23 | IPR002938 | PF01494 | FAD binding domain FAD-binding domain |
| 24 | IPR023753 | G3DSA:3.50.50.60 | FAD/NAD(P)-binding domain |
| 25 | IPR032799 | PF14541 | Xylanase inhibitor C-terminal Xylanase inhibitor, C-terminal |
| 26 | IPR033121 | PS51767 | Peptidase family A1 domain profile. Peptidase family A1 domain |
| 27 | IPR021109 | G3DSA:2.40.70.10 | Aspartic peptidase domain |
| 28 | IPR001461 | PR00792 | Pepsin (A1) aspartic protease family signature Aspartic peptidase A1 family |
| 29 | IPR032861 | PF14543 | Xylanase inhibitor N-terminal Xylanase inhibitor, N-terminal |

TABLE 12-continued

Details of Identified Domains

| Domain Identifier | InterPro No. | Accession No. | Description |
|---|---|---|---|
| 30 | IPR001969 | PS00141 | Eukaryotic and viral aspartyl proteases active site. Aspartic peptidase, active site |
| 31 | IPR003593 | SM00382 | AAA+ ATPase domain |
| 32 | IPR003439 | PS50893 | ATP-binding cassette, ABC transporter-type domain profile. ABC transporter-like |
| 33 | IPR027417 | SSF52540 | P-loop containing nucleoside triphosphate hydrolase |
| 34 | IPR013581 | PF08370 | Plant PDR ABC transporter associated Plant PDR ABC transporter associated |
| 35 | IPR029481 | PF14510 | ABC-transporter extracellular N-terminal ABC-transporter extracellular N-terminal domain |
| 36 | IPR013525 | PF01061 | ABC-2 type transporter ABC-2 type transporter |
| 37 | IPR011991 | SSF46785 | Winged helix-turn-helix DNA-binding domain |
| 38 | IPR000232 | PR00056 | Heat shock factor (HSF) domain signature Heat shock factor (HSF)-type, DNA-binding |
| 39 | IPR033140 | PS01174 | Lipolytic enzymes "G-D-X-G" family, putative serine active site. Lipase, GDXG, putative serine active site |
| 40 | IPR029058 | G3DSA:3.40.50.1820 | Alpha/Beta hydrolase fold |
| 41 | IPR013094 | PF07859 | alpha/beta hydrolase fold Alpha/beta hydrolase fold-3 |
| 42 | IPR016177 | SSF54171 | DNA-binding domain |
| 43 | IPR001471 | PF00847 | AP2 domain AP2/ERF domain |
| 44 | IPR012967 | PF08100 | Dimerisation domain Plant methyltransferase dimerisation |
| 45 | IPR029063 | SSF53335 | S-adenosyl-L-methionine-dependent methyltransferase |
| 46 | IPR001077 | PF00891 | O-methyltransferase O-methyltransferase, family 2 |
| 47 | IPR016461 | PIRSF005739 | O-methyltransferase COMT-type |
| 48 | IPR018170 | PS00798 | Aldo/keto reductase family signature 1. Aldo/keto reductase, conserved site |
| 49 | IPR020471 | PIRSF000097 | Aldo/keto reductase |
| 50 | IPR023210 | SSF51430 | NADP-dependent oxidoreductase domain |
| 51 | IPR011402 | PIRSF036470 | Phospholipase D, plant |
| 52 | IPR000008 | SM00239 | C2 domain |
| 53 | IPR001736 | PS50035 | Phospholipase D phosphodiesterase active site profile. Phospholipase D/Transphosphatidylase |
| 54 | IPR024632 | PF12357 | Phospholipase D C terminal Phospholipase D, C-terminal |
| 55 | IPR023298 | G3DSA:1.20.1110.10 | P-type ATPase, transmembrane domain |
| 56 | IPR024750 | PF12515 | Ca2+-ATPase N terminal autoinhibitory domain Calcium-transporting P-type ATPase, N-terminal autoinhibitory domain |
| 57 | IPR008250 | PF00122 | E1-E2 ATPase P-type ATPase, A domain |
| 58 | IPR023299 | G3DSA:3.40.1110.10 | P-type ATPase, cytoplasmic domain N |
| 59 | IPR006408 | TIGR01517 | ATPase-IIB__Ca: calcium-translocating P-type ATPase, PMCA-type P-type ATPase, subfamily IIB |
| 60 | IPR023214 | G3DSA:3.40.50.1000 | HAD-like domain |
| 61 | IPR004014 | PF00690 | Cation transporter/ATPase, N-terminus Cation-transporting P-type ATPase, N-terminal |
| 62 | IPR001757 | TIGR01494 | ATPase__P-type: HAD ATPase, P-type, family IC P-type ATPase |
| 63 | IPR006068 | PF00689 | Cation transporting ATPase, C-terminus Cation-transporting P-type ATPase, C-terminal |
| 64 | IPR018303 | PS00154 | E1-E2 ATPases phosphorylation site. P-type ATPase, phosphorylation site |
| 65 | IPR002528 | PF01554 | MatE Multi antimicrobial extrusion protein |
| 66 | IPR013216 | PF08241 | Methyltransferase domain Methyltransferase type 11 |
| 67 | IPR003465 | PF02428 | Potato type II proteinase inhibitor family Proteinase inhibitor I20 |
| 68 | IPR006379 | TIGR01484 | HAD-SF-IIB: HAD hydrolase, family IIB HAD-superfamily hydrolase, subfamily IIB |
| 69 | IPR001830 | PF00982 | Glycosyltransferase family 20 Glycosyl transferase, family 20 |
| 70 | IPR003337 | PF02358 | Trehalose-phosphatase Trehalose-phosphatase |
| 71 | IPR000270 | PS51745 | PB1 domain profile. PB1 domain |
| 72 | IPR033389 | PF02309 | AUX/IAA family AUX/IAA domain |
| 73 | IPR008480 | PF05553 | Cotton fibre expressed protein Protein of unknown function DUF761, plant |
| 74 | IPR011527 | PS50929 | ABC transporter integral membrane type-1 fused domain profile. ABC transporter type 1, transmembrane domain |
| 75 | IPR017871 | PS00211 | ABC transporters family signature. ABC transporter, conserved site |
| 76 | IPR000863 | PF00685 | Sulfotransferase domain Sulfotransferase domain |
| 77 | IPR000073 | PF12697 | Alpha/beta hydrolase family Alpha/beta hydrolase fold-1 |
| 78 | IPR004326 | PF03094 | Mlo family Mlo-related protein |
| 79 | IPR003496 | PF02496 | ABA/WDS induced protein ABA/WDS induced protein |
| 80 | IPR004265 | PF03018 | Dirigent-like protein Plant disease resistance response protein |

TABLE 12-continued

Details of Identified Domains

| Domain Identifier | InterPro No. | Accession No. | Description |
|---|---|---|---|
| 81 | IPR025322 | PF14009 | Domain of unknown function (DUF4228) Protein of unknown function DUF4228, plant |
| 82 | IPR004864 | PF03168 | Late embryogenesis abundant protein Late embryogenesis abundant protein, LEA-14 |
| 83 | IPR023395 | G3DSA:1.50.40.10 | Mitochondrial carrier domain |
| 84 | IPR018108 | PS50920 | Solute carrier (Solcar) repeat profile. Mitochondrial substrate/solute carrier |
| 85 | IPR019956 | PR00348 | Ubiquitin signature Ubiquitin |
| 86 | IPR001975 | PF01020 | Ribosomal L40e family Ribosomal protein L40e |
| 87 | IPR011332 | SSF57829 | Zinc-binding ribosomal protein |
| 88 | IPR029071 | SSF54236 | Ubiquitin-related domain |
| 89 | IPR000626 | SM00213 | Ubiquitin domain |
| 90 | IPR017441 | PS00107 | Protein kinases ATP-binding region signature. Protein kinase, ATP binding site |
| 91 | IPR013320 | G3DSA:2.60.120.200 | Concanavalin A-like lectin/glucanase domain |
| 92 | IPR008271 | PS00108 | Serine/Threonine protein kinases active-site signature. Serine/threonine-protein kinase, active site |
| 93 | IPR003441 | PF02365 | No apical meristem (NAM) protein NAC domain |

Example 5: Gene Cloning and Generation of Binary Vectors for Expression in Plants To validate the role of genes identified hereinabove in increasing resistance to fungal infection selected genes were over-expressed in plants, as follows.

Cloning Strategy

Selected genes from those presented in Examples 1-4 hereinabove were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from roots or shoots challenged by the relevant pathogen. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York) which are well known to those skilled in the art. PCR products were purified using PCR purification kit (Qiagen).

Typically, 2 sets of primers were prepared for the amplification of each gene, via nested PCR (if required). Both sets of primers were used for amplification on a cDNA. In case no product was obtained, a nested PCR reaction was performed. Nested PCR was performed by amplification of the gene using external primers and then using the produced PCR product as a template for a second PCR reaction, where the internal set of primers was used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc.) according to the sites designed in the primers. Each digested/undigested PCR product was inserted into a high copy vector pUC19 (New England BioLabs Inc.), or into plasmids originating from this vector. In some cases the undigested PCR product was inserted into pCR-Blunt II-TOPO (Invitrogen) or into pJET1.2 (CloneJET PCR Cloning Kit, Thermo Scientific) or directly into the binary vector. The digested/undigested products and the linearized plasmid vector were ligated using T4 DNA ligase enzyme (Roche, Switzerland or other manufacturers). In cases where pCR-Blunt II-TOPO is used no T4 ligase was needed.

Sequencing of the inserted genes was performed using the ABI 377 sequencer (Applied Biosystems). In some cases, after confirming the sequences of the cloned genes, the cloned cDNA was introduced into a modified pGI binary vector containing the At6669 promoter (SEQ ID NO:25), such as the pQFNc or pQsFN vectors, and the NOS terminator (SEQ ID NO:36) via digestion with appropriate restriction endonucleases.

Several DNA sequences of the selected genes were synthesized by GenScript (GenScript, Piscataway, N.J., USA). Synthetic DNA was designed in silico. Suitable restriction enzyme sites were added to the cloned sequences at the 5' end and at the 3' end to enable later cloning into the desired binary vector.

Binary Vectors—

The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI is similar to pPI, but the original gene in the backbone is GUS-Intron and not GUS.

Figure 2:
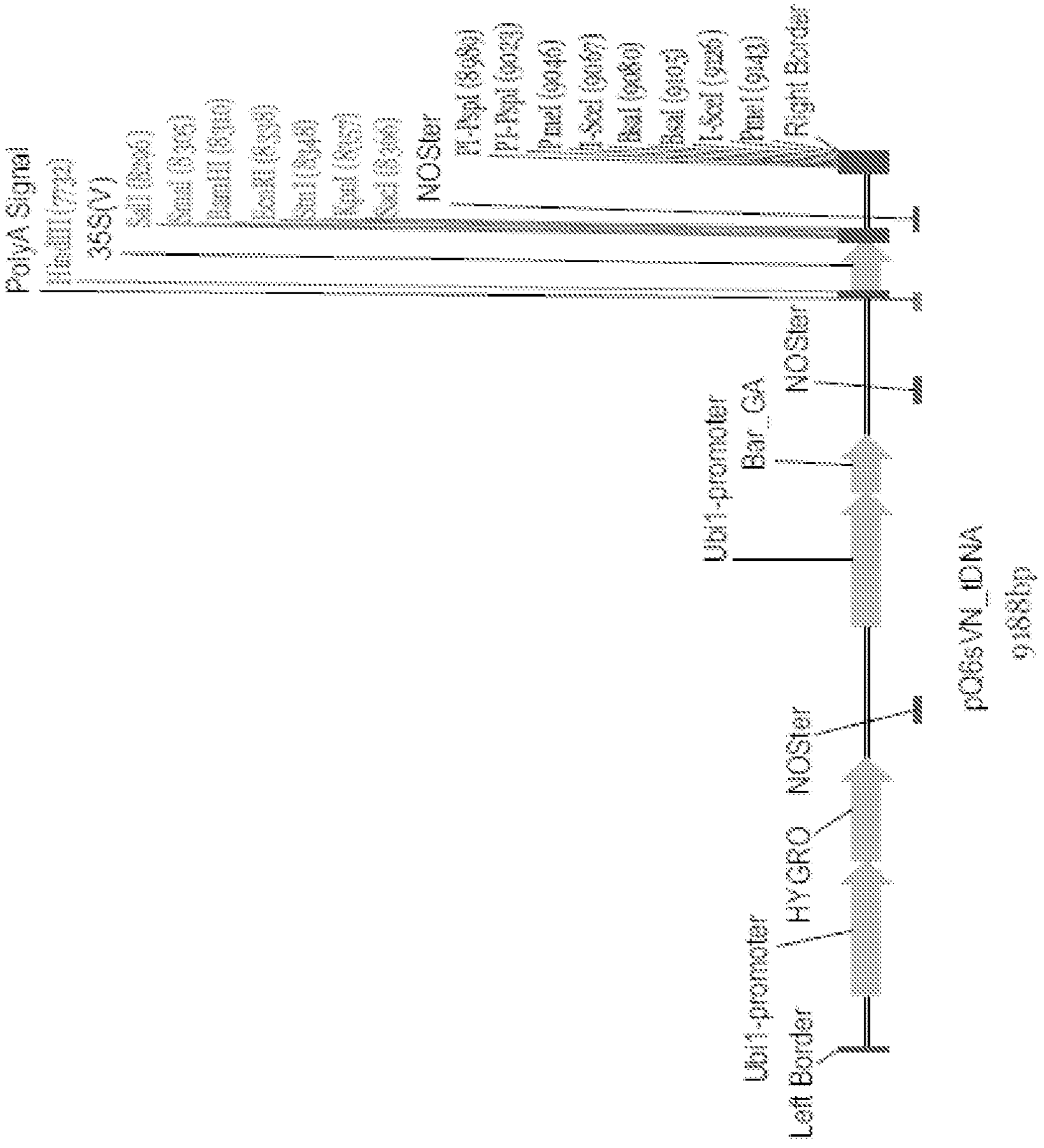
FIG. 2 is a schematic illustration of the pQ6sVN plasmid. pQ6sVN used for expression of the isolated polynucleotide sequences of some embodiments of the invention in *Brachypodium*. "35S(V)"=35S promoter (SEQ ID NO:37); "NOS ter"=nopaline synthase terminator; "Bar_GA"=BAR open reading frame optimized for expression in *Brachypodium* (SEQ ID NO:39); "Hygro"=Hygromycin resistance gene. "Ubi1 promoter"=SEQ ID NO:11; the isolated polynucleotide sequences of some embodiments of the invention were cloned into the Multiple cloning site of the vector (downstream of the "35S(V)" promoter) using one or more of the indicated restriction enzyme sites.
Figure 3:
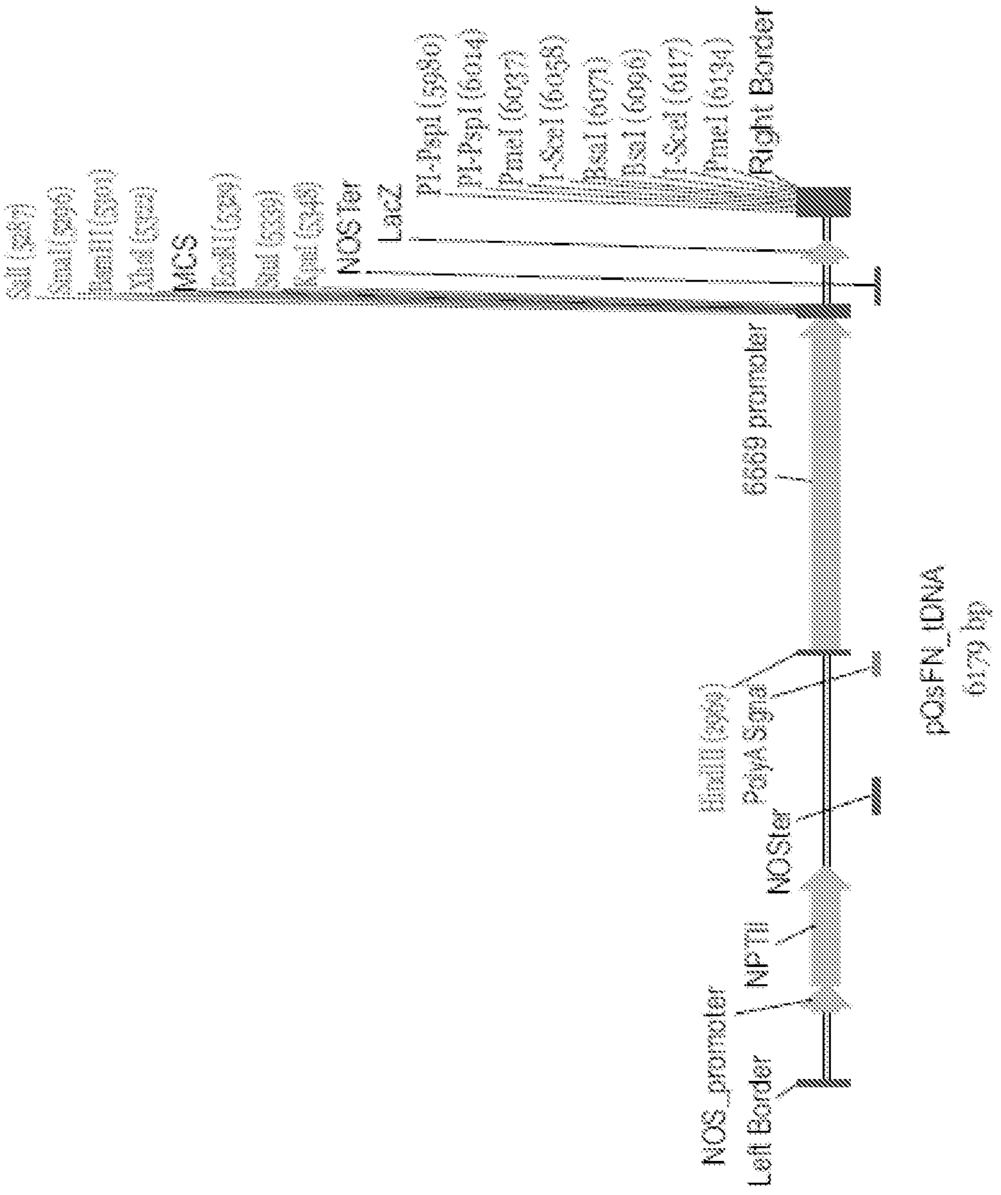
FIG. 3 is a schematic illustration of the pQsFN plasmid containing the new *Arabidopsis thaliana* 6669 promoter (SEQ ID NO: 25) used for expression of the isolated polynucleotide sequences of the invention in *Arabidopsis*. Right Border—T-DNA right border; Left Border—T-DNA left border; MCS—Multiple cloning site; NOS promoter=nopaline synthase promoter; NPT-II=neomycin phosphotransferase gene; NOS ter=nopaline synthase terminator; Poly-A signal (polyadenylation signal); The isolated polynucleotide sequences of the invention were cloned into the MCS of the vector.

The modified pGI vector (e.g., pQFN, pQFNc, pQFNd, pQYN_6669, pQNa_RP, pQFYN, pQXNc, pQ6sVN (FIG. 2) or pQsFN (FIG. 3) is a modified version of the pGI vector in which the cassette is inverted between the left and right borders so the gene and its corresponding promoter are close to the right border and the NPTII gene is close to the left border.

In case of *Brachypodium* transformation, after confirming the sequences of the cloned genes, the cloned cDNAs were introduced into pQ6sVN (FIG. 2) containing 35S promoter (SEQ ID NO:35) and the NOS terminator (SEQ ID NO:36) via digestion with appropriate restriction endonucleases. The genes were cloned downstream to the 35S promoter and upstream to the NOS terminator. In the pQ6sVN vector the Hygromycin resistance gene cassette and the Bar_GA resistance gene cassette replaced the NPTII resistance gene cassette. pQ6sVN contains the 35S promoter (SEQ ID NO: 37). Bar_GA resistance gene (SEQ ID NO: 39) is an optimized sequence of the BAR gene for expression in *Brachypodium* plants (ordered from GenScript™).

Additionally or alternatively, *Brachypodium* transformation was performed using the pEBbVNi vector. pEBbVNi (FIG. 1A) is a modified version of pJJ2LB in which the Hygromycin resistance gene was replaced with the BAR gene which confers resistance to the BASTA herbicide [BAR gene coding sequence is provided in GenBank Accession No. JQ293091.1 (SEQ ID NO:38); further description is provided in Akama K, et al. "Efficient *Agrobacterium*-mediated transformation of *Arabidopsis* thaliana using the bar gene as selectable marker", Plant Cell Rep. 1995, 14(7):450-4; Christiansen P, et al. "A rapid and efficient transformation protocol for the grass *Brachypodium distachyon*", Plant Cell Rep. 2005 March; 23(10-11):751-8. Epub 2004 Oct. 19; and Păcurar D I, et al. "A high-throughput *Agrobacterium*-mediated transformation system for the grass model species *Brachypodium distachyon* L", Transgenic Res. 2008 17(5):965-75; each of which is fully incorporated herein by reference in its entirety). The pEBbVNi construct contains the 35S promoter (SEQ ID NO:37). pJJ2LB is a modified version of pCambia0305.2 (Cambia).

In case genomic DNA was cloned, the genes were amplified by direct PCR on genomic DNA extracted from leaf tissue using the DNAeasy kit (Qiagen Cat. No. 69104).

Table 13 hereinbelow provides a list of the gene cloned, including gene name, the plasmid used, the organism from which the gene is derived, the SEQ ID NO. of the primer used and the SEQ ID NO. of the gene polynucleotide and encoded polypeptide.

TABLE 13

Cloned genes

| Gene Name | High copy plasmid | Organism | Primers used (SEQ ID NOs) | Polyn. (SEQ ID NO) | Polypep. (SEQ ID NO) |
|---|---|---|---|---|---|
| LAB511 | pUC19c_LAB511 | *Zea mays* | | 566 | 968 |
| LFS10 | pMA-RQ_LFS10_GA | *Hordeum vulgare* | 1030 | 128 | 578 |
| LFS11 | pQ6sVN_LFS11 | *Zea mays* | 1104, 1000, 1104, 995 | 129 | 637 |
| LFS13 | pQ6sVN_LFS13 | *Zea mays* | 1059, 1094, 1019 | 130 | 580 |
| LFS14 | pMA-RQ_LFS14_GA | *Zea mays* | 1026 | 131 | 581 |
| LFS15 | pQ6sVN_LFS15 | *Zea mays* | 1082, 1029, 1082, 1026 | 132 | 582 |
| LFS16 | pQ6sVN_LFS16 | *Zea mays* | 1047, 1055, 1047, 1029 | 133 | 583 |
| LFS17 | pQ6sVN_LFS17 | *Zea mays* | 1046, 1028, 1050, 1087 | 134 | 638 |
| LFS18 | pQ6sVN_LFS18 | *Zea mays* | 1115, 1093, 1022 | 135 | 639 |
| LFS19 | pQ6sVN_LFS19_GA | *Zea mays* | | 136 | 586 |
| LFS2 | pMA-RQ_LFS2_GA | *Hordeum vulgare* | 1038 | 121 | 571 |
| LFS21 | pQ6sVN_LFS21 | *Zea mays* | 1001, 979, 986, 1036 | 137 | 587 |
| LFS22 | TopoB_LFS22 | *Zea mays* | 1098, 1033, 1062, 1004 | 533 | 940 |
| LFS24 | pQ6sVN_LFS24 | *Zea mays* | 1071, 1092, 1042 | 138 | 589 |
| LFS25 | pUC57_LFS25_GA | *Zea mays* | 1012 | 139 | 590 |
| LFS26 | pQ6sVN_LFS26 | *Zea mays* | 1072, 1013, 1072, 1012 | 140 | 640 |
| LFS27 | pQ6sVN_LFS27 | *Zea mays* | 1090, 988, 1090, 1013 | 141 | 641 |
| LFS28 | pQ6sVN_LFS28 | *Zea mays* | 1063, 1063, 989 | 534 | 966 |
| LFS29 | pQ6sVN_LFS29_GA | *Zea mays* | | 142 | 593 |
| LFS3 | pMA-RQ_LFS3_GA | *Hordeum vulgare* | 1024 | 122 | 572 |
| LFS30 | pUCsVN_LFS30 | *Zea mays* | 1113, 1040, 1113, 997 | 143 | 642 |
| LFS31 | pQ6sVN_LFS31 | *Zea mays* | 987, 987, 1040 | 144 | 595 |
| LFS32 | pUC57_LFS32_GA | *Zea mays* | 994 | 145 | 596 |
| LFS33 | pQ6sVN_LFS33 | *Zea mays* | 1080, 1014, 1080, 994 | 146 | 597 |
| LFS34 | pQ6sVN_LFS34 | *Zea mays* | 1095, 1088, 1031 | 147 | 598 |
| LFS35 | pUC57_LFS35_GA | *Zea mays* | | 148 | 599 |
| LFS36 | pMA-RQ_LFS36_GA | *Zea mays* | 1101 | 149 | 600 |
| LFS37 | pQ6sVN_LFS37 | *Zea mays* | 1127, 1123, 1127, 1081 | 150 | 601 |
| LFS38 | pQ6sVN_LFS38 | *Zea mays* | 1091, 993, 1109, 1121 | 151 | 643 |
| LFS39 | pQ6sVN_LFS39 | *Zea mays* | 1048, 1045, 1032 | 152 | 603 |
| LFS4 | pMA-RQ_LFS4_GA | *Hordeum vulgare* | | 123 | 573 |
| LFS40 | pUC57_LFS40_GA | *Zea mays* | 981 | 535 | 941 |
| LFS42 | TopoB_LFS42 | *Zea mays* | 1110, 982, 1110, 981 | 153 | 604 |
| LFS43 | TopoB_LFS43 | *Zea mays* | 1060, 1125, 1060, 982 | 154 | 644 |
| LFS44 | TopoB_LFS44 | *Zea mays* | 1076, 1010, 1076, 1120 | 155 | 606 |
| LFS45 | TopoB_LFS45 | *Sorghum bicolor* | 1056, 1117, 1067, 1011 | 156 | 607 |
| LFS46 | TopoB_LFS46 | *Sorghum bicolor* | 1118, 984, 1122, 1126 | 157 | 608 |
| LFS47 | TopoB_LFS47 | *Sorghum bicolor* | 1112, 1041, 1112, 1015 | 158 | 645 |
| LFS48 | TopoB_LFS48 | *Sorghum bicolor* | 1129, 990, 1128, 1035 | 536 | 943 |
| LFS49 | pQ6sVN_LFS49 | *Sorghum bicolor* | 1061, 1021, 1061, 990 | 159 | 610 |
| LFS50 | pQ6sVN_LFS50 | *Sorghum bicolor* | 1053, 998, 1077, 1009 | 160 | 611 |
| LFS52 | pQ6sVN_LFS52 | *Sorghum bicolor* | 1068, 1039, 1099, 983 | 161 | 646 |
| LFS53 | pQ6sVN_LFS53 | *Sorghum bicolor* | 1058, 1016, 1069, 1037 | 162 | 614 |
| LFS54 | pQ6sVN_LFS54 | *Sorghum bicolor* | 1054, 1018, 1070, 1006 | 163 | 615 |
| LFS55 | pQ6sVN_LFS55 | *Sorghum bicolor* | 1116, 1083, 1102, 980 | 164 | 647 |
| LFS57 | pQ6sVN_LFS57 | *Sorghum bicolor* | 1049, 1020, 1044, 1065 | 165 | 617 |
| LFS58 | pQ6sVN_LFS58 | *Sorghum bicolor* | 1106, 1051, 1106, 1020 | 166 | 618 |
| LFS59 | TopoB_LFS59 | *Sorghum bicolor* | 1052, 1052, 1051 | 167 | 619 |

TABLE 13-continued

| Cloned genes | | | | | |
|---|---|---|---|---|---|
| Gene Name | High copy plasmid | Organism | Primers used (SEQ ID NOs) | Polyn. (SEQ ID NO) | Polypep. (SEQ ID NO) |
| LFS6 | pMA-RQ_LFS6_GA | *Hordeum vulgare* | | 124 | 574 |
| LFS60 | pUC57_LFS60_GA | *Sorghum bicolor* | | 168 | 620 |
| LFS61 | pUC57_LFS61_GA | *Sorghum bicolor* | 1043 | 169 | 621 |
| LFS62 | TopoB_LFS62 | *Sorghum bicolor* | 1073, 991, 1073, 1043 | 170 | 648 |
| LFS65 | pQ6sVN_LFS65 | *Sorghum bicolor* | 1066, 1119, 1079, 1008 | 171 | 623 |
| LFS66 | TopoB_LFS66 | *Sorghum bicolor* | 1097, 1097, 1124 | 172 | 624 |
| LFS67 | pUC57_LFS67_GA | *Triticum aestivum* | 978 | 173 | 625 |
| LFS68 | pQ6sVN_LFS68 | *Triticum aestivum* | 1057, 1114, 992 | 174 | 649 |
| LFS7 | pMA-T_LFS7_GA | *Hordeum vulgare* | 1023 | 125 | 575 |
| LFS70 | pQ6sVN_LFS70 | *Triticum aestivum* | 1084, 1084, 1023 | 175 | 650 |
| LFS71 | pQ6sVN_LFS71_GA | *Triticum aestivum* | 985 | 176 | 628 |
| LFS72 | TopoB_LFS72 | *Triticum aestivum* | 1111, 1075, 1111, 985 | 177 | 651 |
| LFS73 | TopoB_LFS73 | *Triticum aestivum* | 1074, 1005, 1096, 1108 | 178 | 652 |
| LFS74 | TopoB_LFS74 | *Triticum aestivum* | 1103, 1034, 1105, 1025 | 179 | 631 |
| LFS75 | pQ6sVN_LFS75 | *Triticum aestivum* | 996, 999, 996, 1034 | 180 | 653 |
| LFS76 | pQ6sVN_LFS76 | *Triticum aestivum* | 1089, 1017, 1078, 1003 | 181 | 633 |
| LFS77 | pQ6sVN_LFS77 | *Triticum aestivum* | 1085, 1007, 1100, 1002 | 182 | 634 |
| LFS78 | pQ6sVN_LFS78 | *Triticum aestivum* | 1107, 1086, 1007 | 183 | 654 |
| LFS79 | pMA-RQ_LFS79_GA | *Hordeum vulgare* | | 537 | 967 |
| LFS8 | pMA-RQ_LFS8_GA | *Hordeum vulgare* | 1027 | 126 | 576 |
| LFS80 | TopoB_LFS80 | *Zea mays* | 1064, 1064, 1027 | 184 | 636 |
| LFS9 | pMA-RQ_LFS9_GA | *Hordeum vulgare* | | 127 | 577 |

"GA"—GenScript (synthetically prepared gene sequence);
Polyn. = polynucleotide;
Polypep. = polypeptide

Example 6: Transformation of *Brachypodium distachyon* Plants with the Polynucleotides of the Invention Similar to the *Arabidopsis* model plant, *Brachypodium distachyon* has several features that recommend it as a model plant for functional genomic studies, especially in the grasses. Traits that make it an ideal model include its small genome (~160 Mbp for a diploid genome and 355 Mbp for a polyploidy genome), small physical stature, a short lifecycle, and few growth requirements. *Brachypodium* is related to the major cereal grain species but is understood to be more closely related to the Triticeae (wheat, barley) than to the other cereals. *Brachypodium*, with its polyploidy accessions, can serve as an ideal model for these grains (whose genomics size and complexity is a major barrier to biotechnological improvement).

*Brachypodium distachyon* embryogenic calli are transformed using the procedure described by Vogel and Hill (2008. High-efficiency *Agrobacterium*-mediated transformation of *Brachypodium distachyon* inbred line Bd21-3. Plant Cell Rep 27:471-478); Vain et al (2008. *Agrobacterium*-mediated transformation of the temperate grass *Brachypodium distachyon* (genotype Bd21) for T-DNA insertional mutagenesis. Plant Biotechnology J 6: 236-245), and Vogel J, et al. (2006. *Agrobacterium* mediated transformation and inbred line development in the model grass *Brachypodium* distachyon. Plant Cell Tiss Org. Cult. 85:199-211), each of which is fully incorporated herein by reference, with some minor modifications, which are briefly summarized herein below.

Callus Initiation—

Immature spikes (about 2 months after seeding) are harvested at the very beginning of seeds filling. Spikes are then husked and surface sterilized with 3% NaClO containing 0.1% Tween 20, shaken on a gyratory shaker at low speed for 20 minutes. Following three rinses with sterile distilled water, embryos are excised under a dissecting microscope in a laminar flow hood using fine forceps.

Excised embryos (size ~0.3 mm, bell shaped) are placed on callus induction medium (CIM) [LS salts (Linsmaier, E. M. & Skoog, F. 1965. Physiol. Plantarum 18, 100) and vitamins plus 3% sucrose, 6 mg/L $CuSO_4$, 2.5 mg/12,4-Dichlorophenoxyacetic Acid, pH 5.8 and 0.25% phytagel (Sigma)] scutellar side down, 50 or 100 embryos on a plate, and incubated at 28° C. in the dark. One week later, the embryonic calli is cleaned from emerging shoots and somatic calli, and subcultured onto fresh CIM medium. During culture, yellowish embryogenic calli (EC) appear and are further selected (e.g., picked and transferred) for further incubation in the same conditions for additional 2 weeks. Twenty-five pieces of sub-cultured calli are then separately placed on 90×15 mm petri plates, and incubated as before for three additional weeks.

Transformation—

As described in Vogel and Hill (2008, Supra), *Agrobacterium* is scraped off 2-day-old MGL plates (plates with the MGL medium which contains: Tryptone 5 gr/L, Yeast Extract 2.5 gr/L, NaCl 5 gr/L, D-Mannitol 5 g/l, $MgSO_4$*$7H_2O$ 0.204 gr/L, $K_2HPO_4$ 0.25 gr/L, Glutamic Acid 1.2 gr/L, Plant Agar 7.5 gr/L) and resuspended in liquid MS medium supplemented with 200 μM acetosyringone to an optic density (OD) at 600 nm ($OD_{600}$) of 0.6 to 1.0. Once the desired OD was attained, 1 ml of 10% Synperonic PE/F68 (Sigma) per 100 nil of inoculation medium is added.

To begin inoculation, 300 callus pieces are placed in approximately 12 plates (25 callus pieces in each plate) and covered with the *Agrobacterium* suspension (8-10 ml). The callus is incubated in the *Agrobacterium* suspension for 5 to 20 minutes. After incubation, the *Agrobacterium* suspension is aspirated off and the calli are then transferred into co-cultivation plates, prepared by placing a sterile 7-cm diameter filter paper in an empty 90×15 mm petri plate. The calli pieces are then gently distributed on the filter paper. One co-cultivation plate is used for two starting callus plates (50 initial calli pieces). The co-cultivation plates are then sealed with Parafilm M® or a plastic wrap [e.g., Saran™ wrap (Dow Chemical Company)] and incubated at 24° C. in the dark for 3 days.

The callus pieces are then individually transferred into CIM medium as described above, which is further supplemented with 200 mg/L Ticarcillin (to kill the *Agrobacterium*) and Bialaphos (5 mg/L) or Hygromycin B (40 mg/L) (for selection of the transformed resistant embryogenic calli sections), and incubated at 28° C. in the dark for 14 days.

The calli pieces are then transferred to shoot induction media (SIM; LS salts and vitamins plus 3% Maltose monohydrate) supplemented with 400 mg/L Ticarcillin, Bialaphos (5 mg/L) or Hygromycin B (40 mg/L), Indol-3-acetic acid (IAA) (0.25 mg/L), and 6-Benzylaminopurine (BAP) (1 mg/L), and are cultivated in conditions as described below. After 10-15 days calli are sub-cultured on the same fresh media for additional 10-15 days (total of 20-30 days). At each sub-culture all the pieces from a single callus are kept together to maintain their independence and are incubated under the following conditions: light to a level of 60 lE $m^{-2}$ $s^{-1}$, a 16-hours light, 8-hours dark photoperiod and a constant 24° C. temperature. During the period of 20 to 30 days from the beginning of cultivation of calli on shoot induction media (SIM) plantlets start to emerge from the transformed calli.

When plantlets are large enough to handle without damage, they are transferred to plates containing the above mentioned shoot induction media (SIM) with Bialaphos or Hygromycin B. Each plantlet is considered as a different event. After two weeks of growth, the plantlets are transferred to 2-cm height Petri plates (De Groot, Catalog No. 60-664160) containing MSnoH media (MS salts 4.4 gr/L, sucrose 30 gr/L, supplemented with Hygromycine B (40 mg/L) and Ticarcillin (400 mg/L). Roots usually appear within 2 weeks. Rooted and non-rooted plants are transferred to a fresh MSnoH media supplemented with Hygromycin B and Ticarcillin as described above. In case roots do not appear in the non-rooted plants after two weeks on the MSnoH media (which is supplemented with Hygromycin B and Ticarcillin), then the non-rooted plants are further transferred to the rooting induction medium [RIM; MS salts and vitamins 4.4 gr/L, sucrose 30 gr/L with Ticarcillin 400 mg/L, Indol-3-acetic acid (IAA) (1 mg/L), and α-Naphthalene acetic acid (NAA) (2 mg/L)]. After additional two weeks of incubation at 24° C., the plantlets are transferred to 0.5 modified RIM medium [MS modified salts 4.4 gr/L, MS vitamins 103 mg/L, sucrose 30 gr/L with α-Tocopherol (2 mg/L), Indol-3-acetic acid (IAA) (1 mg/L), and α-Naphthalene acetic acid (NAA) (2 mg/L)] and are incubated at 28° C. for additional 15-20 days, till the roots appear.

If needed, in the tillering stage the plantlets can grow axillary tillers and eventually become bushy on the above mentioned media (SIM) without Bialaphos or Hygromycin B. Each bush from the same plant (event ID) is then divided to tissue culture boxes ("Humus") containing "rooting medium" [MS basal salts, 3% sucrose, 3 gr/L phytagel, 2 mg/L α-Naphthalene Acetic Acid (NAA) and 1 mg/L IAA and Ticarcillin 400 mg/L, PH 5.8]. All plants in a "Humus box" are individual plants of the same transformation event.

When plantlets establish roots they are transplanted to the soil and grown in the greenhouse. Before transfer to greenhouse, 20 randomly selected events are tested every month for expression of the BAR_GA gene (SEQ ID NO:39, BAR gene) which is responsible for resistance to Bialaphos, using AgraStrip® LL strip test seed check (Romer labs). Briefly, the expression of the BAR gene is determined as follows: Leaves (about 0.5 cm long leave) are grounded using a pellet pestle in an Eppendorf tube containing 150 μl of water until the water turns green in color. A strip test is then added to the Eppendorf tube and the results are read within 30-60 seconds. Appearance of two pink bands means that the plant is transgenic. On the other hand, appearance of one pink band means that the plant is not transgenic or not expressing BAR gene.

To verify the transgenic status of plants containing the gene of interest, T1 plants are subjected to PCR as previously described by Vogel et al. 2006 [*Agrobacterium* mediated transformation and inbred line development in the model grass *Brachypodium* distachyon. Plant Cell Tiss Org. Cult. 85:199-211].

Example 7: Validation Assays

The transgenic *Brachypodium* plants obtained as described hereinabove were used to validate the effect of the transformed gene(s) on fungal penetration and spreading within the plant by evaluation of fungal penetration and spreading within inoculated seedlings grown under controlled conditions.

Each validation assay evaluates the gene performance by quantitative and/or qualitative measure of specific traits as described in Table 14 below.

TABLE 14

Allocation of fungal parameters to specific traits

| # | Parameters | Traits |
|---|---|---|
| 1 | Fungal biomass in root | Fungal presence in tissue |
| 2 | Fungal biomass in stem | Fungal spreading in organ |

The validation assay was performed with inoculated transgenic plants grown under controlled conditions till seedling stage (1-2 tilles).

Transgenic *Brachypodium* seeds were sown in trays contained sterilized vermiculite soaked with 0.1% BASTA solution for transgenic plants selection. The trays were placed in the refrigerator where they undergo cold treatment for 3 days at 4° C. (stratification step) following by trays placement in controlled growth chamber for germination up to 5 days.

The viable transgenic seedlings were inoculated with a spore solution of *Fusarium* verticillioides (Fv) at $10^4$ spores/ml s (Fv 149 strain, CFP-tagged and bar resistant) and then transplanted to 180 $cm^3$ pots filled with sterilized vermiculite. The plants were grown up to 14 days in the growth chamber (temperature 26° C.±1, humidity of 50%).

Fungal extraction from each of the biological repeat (6 root or 6 stems) were plated in petri dish with 3 dilution degree and incubated for 5 days in 25° C. Plates were counting for colony forming units (CFU) using florescent binocular and data were transformed to logarithmic scale for further analysis.

Assay Type 1: Measurement of Fungal Biomass

Fungal Biomass—Log CFU of fungal root extraction 7 days after inoculation

Assay Type 2: Measurement of Fungal Biomass

Fungal Biomass—Log CFU of fungal stem extraction 14 days after inoculation

Statistical analyses—To identify genes conferring significantly improved tolerance to fungal penetration and fungal spreading, the results obtained from the transgenic plants were compared to those obtained from control plants. To identify outperforming genes and constructs, results from the independent transformation events tested were analyzed separately. Analysis was conducted on the log CFU data using Student's t-test. The JMP statistics software package was used (Version 5.2.1, SAS Institute Inc., Cary, N.C., USA).

Table 15 hereinbelow shows the reduction in CFU in the tested infected plants and its significance compared to control plants. Negative numbers indicate increase in the CFU number.

Cloned genes which conferred significant reduction in CFU in at least one transformed plant (event) in two different assays were designated as preferred candidates for conferring and/or enhancing resistance when expressed in the plants. Among these genes are LFS24; LFS49; LFS53; LFS10; LFS9; LFS18; LFS30; LFS36; LFS27; LFS50; LFS19; LFS29; LFS72; LFS8; LFS78; LFS45; LFS7; LFS40; LFS4; LFS47; LFS48; LFS73; LFS74; and LFS75. Cloned genes which enhanced susceptibility to the fungal infection (at least three transformed plants (events) affording >30% susceptibility) were designated as preferred candidates the expression of which is to be reduced (knocked down or knocked out) in order to confer and/or enhance resistance to the fungus. Among these genes are LFS25; LFS39; and LFS59.

TABLE 15

Validation results in *Brachypodium* plant-infected with Fv

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| LAB511 | 565 | 965 | 566 | 968 | Root | maize | First assay:<br>Event 7659.1: −3% (not significant, p_value = 0.20)<br>Event 7660.1: 0% (not significant, p_value = 0.44)<br>Event 7661.1: −3% (not significant, p_value = 0.18)<br>Event 7663.1: −6% (significant, p_value = 0.03)<br>Event 8702.1: −8% (significant, p_value = 0.01)<br>Second assay:<br>Event 7659.1: −1% (not significant, p_value = 0.44)<br>Event 7660.1: 5% (significant, p_value = 0.07)<br>Event 7661.1: 0% (not significant, p_value = 0.48)<br>Event 7663.1: 4% (significant, p_value = 0.09)<br>Event 8702.1: 3% (not significant, p_value = 0.16) | First assay:<br>Event 7659.1: −21%<br>Event 7660.1: 3%<br>Event 7661.1: −21%<br>Event 7663.1: −38%<br>Event 8702.1: −47%<br>Second assay:<br>Event 7659.1: −9%<br>Event 7660.1: 43%<br>Event 7661.1: −1%<br>Event 7663.1: 37%<br>Event 8702.1: 29% |
| LFS11 | 63 | 579 | 129 | 637 | Shoot | maize | First assay:<br>Event 9087.1: 10% (significant, p_value = 0.00)<br>Event 9088.1: 1% (not significant, p_value = 0.36)<br>Event 9089.1: 12% (significant, p_value = 0.00)<br>Event 9093.1: 5% (significant, p_value = 0.06)<br>Event 9095.1: 5% (significant, p_value = 0.04)<br>Second assay:<br>Event 9087.1: −9% (significant, p_value = 0.00)<br>Event 9088.1: −15% (significant, p_value = 0.00)<br>Event 9089.1: −4% (significant, p_value = 0.03)<br>Event 9093.1: −6% (significant, p_value = 0.00)<br>Event 9095.1: −7% (significant, p_value = 0.00) | First assay:<br>Event 9087.1: 147%<br>Event 9088.1: 11%<br>Event 9089.1: 188%<br>Event 9093.1: 54%<br>Event 9095.1: 62%<br>Second assay:<br>Event 9087.1: −61%<br>Event 9088.1: −79%<br>Event 9089.1: −37%<br>Event 9093.1: −48%<br>Event 9095.1: −51% |
| LFS15 | 66 | 582 | 132 | 582 | Shoot | maize | First assay:<br>Event 8098.1: −6% (not significant, p_value = 0.11)<br>Event 8089.1: −4% (not significant, p_value = 0.17)<br>Event 8101.1: −8% (significant, p_value = 0.02)<br>Event 8095.1: 2% (not significant, p_value = 0.16)<br>Event 8100.1: −5% (not significant, p_value = 0.11)<br>Second assay:<br>Event 8098.1: −1% (not significant, p_value = 0.37)<br>Event 8089.1: −4% (not significant, p_value = 0.12)<br>Event 8101.1: 6% (significant, p_value = 0.04)<br>Event 8095.1: −5% (significant, p_value = 0.08)<br>Event 8100.1: −3% (not significant, p_value = 0.21) | First assay:<br>Event 8098.1: −43%<br>Event 8089.1: −33%<br>Event 8101.1: −56%<br>Event 8095.1: 28%<br>Event 8100.1: −40%<br>Second assay:<br>Event 8098.1: −12%<br>Event 8089.1: −34%<br>Event 8101.1: 98%<br>Event 8095.1: −41%<br>Event 8100.1: −29% |
| LFS16 | 67 | 583 | 133 | 583 | Shoot | maize | First assay:<br>Event 8152.1: −7% (significant, p_value = 0.02)<br>Event 8153.1: −7% (significant, p_value = 0.02)<br>Event 8758.1: −1% (not significant, p_value = 0.34)<br>Event 8757.1: −10% (significant, p_value = 0.00)<br>Event 8151.1: −10% (significant, p_value = 0.00)<br>Second assay:<br>Event 8152.1: −2% (not significant, p_value = 0.31) | First assay:<br>Event 8152.1: −44%<br>Event 8153.1: −44%<br>Event 8758.1: −10%<br>Event 8757.1: −57%<br>Event 8151.1: −58%<br>Second assay:<br>Event 8152.1: −13% |

TABLE 15-continued

Validation results in *Brachypodium* plant-infected with Fv

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| | | | | | | | Event 8153.1: 8% (significant, p_value = 0.03) | Event 8153.1: 85% |
| | | | | | | | Event 8758.1: 11% (significant, p_value = 0.00) | Event 8758.1: 129% |
| | | | | | | | Event 8757.1: 6% (significant, p_value = 0.06) | Event 8757.1: 60% |
| | | | | | | | Event 8151.1: 15% (significant, n value = 0.00) | Event 8151.1: 216% |
| LFS22 | 528 | 940 | 533 | 940 | Root | maize | First assay: | First assay: |
| | | | | | | | Event 9622.1: 8% (significant, p_value = 0.01) | Event 9622.1: 88% |
| | | | | | | | Event 9229.1: 15% (significant, p_value = 0.00) | Event 9229.1: 213% |
| | | | | | | | Event 9230.1: 0% (not significant, p_value = 0.48) | Event 9230.1: 0% |
| | | | | | | | Event 9231.1: 12% (significant, p_value = 0.00) | Event 9231.1: 159% |
| | | | | | | | Event 9620.1: 6% (significant, p_value = 0.04) | Event 9620.1: 65% |
| | | | | | | | Second assay: | Second assay: |
| | | | | | | | Event 9622.1: 1% (not significant, p_value = 0.42) | Event 9622.1: 9% |
| | | | | | | | Event 9229.1: 1% (not significant, p_value = 0.42) | Event 9229.1: 9% |
| | | | | | | | Event 9230.1: −6% (not significant, p_value = 0.10) | Event 9230.1: −44% |
| | | | | | | | Event 9231.1: −8% (significant, p_value = 0.06) | Event 9231.1: −50% |
| | | | | | | | Event 9620.1: 2% (not significant, p_value = 0.31) | Event 9620.1: 27% |
| LFS24 | 73 | 589 | 138 | 589 | Shoot | maize | First assay: | First assay: |
| | | | | | | | Event 8565.1: 4% (significant, p_value = 0.05) | Event 8565.1: 48% |
| | | | | | | | Event 8562.1: −6% (significant, p_value = 0.03) | Event 8562.1: −40% |
| | | | | | | | Event 8568.1: −6% (significant, p_value = 0.02) | Event 8568.1: −43% |
| | | | | | | | Event 8569.1: 5% (significant, p_value = 0.04) | Event 8569.1: 56% |
| | | | | | | | Event 8567.1: 3% (significant, p_value = 0.09) | Event 8567.1: 40% |
| | | | | | | | Second assay: | Second assay: |
| | | | | | | | Event 8565.1: −6% (significant, p_value = 0.00) | Event 8565.1: −42% |
| | | | | | | | Event 8562.1: −2% (not significant, p_value = 0.16) | Event 8562.1: −18% |
| | | | | | | | Event 8568.1: −7% (significant, p_value = 0.00) | Event 8568.1: −48% |
| | | | | | | | Event 8569.1: 5% (significant, p_value = 0.01) | Event 8569.1: 59% |
| | | | | | | | Event 8567.1: −1% (not significant, p_value = 0.20) | Event 8567.1: −16% |
| LFS28 | 529 | 966 | 534 | 966 | Root | maize | First assay: | First assay: |
| | | | | | | | Event 8114.1: −2% (not significant, p_value = 0.26) | Event 8114.1: −17% |
| | | | | | | | Event 8108.1: 4% (not significant, p_value = 0.14) | Event 8108.1: 40% |
| | | | | | | | Event 8109.1: −2% (not significant, p_value = 0.28) | Event 8109.1: −16% |
| | | | | | | | Event 8111.1: 0% (not significant, p_value = 0.42) | Event 8111.1: −5% |
| | | | | | | | Event 8115.1: −2% (not significant, p_value = 0.24) | Event 8115.1: −17% |
| | | | | | | | Second assay not available | Second assay not available |
| LFS33 | 81 | 597 | 146 | 597 | Root | maize | First assay: | First assay: |
| | | | | | | | Event 8159.1: 5% (not significant, p_value = 0.11) | Event 8159.1: 55% |
| | | | | | | | Event 8170.1: 12% (significant, p_value = 0.00) | Event 8170.1: 161% |
| | | | | | | | Event 8161.1: 4% (not significant, p_value = 0.19) | Event 8161.1: 35% |
| | | | | | | | Event 8162.1: 1% (not significant, p_value = 0.40) | Event 8162.1: 9% |
| | | | | | | | Event 8163.1: −3% (not significant, p_value = 0.20) | Event 8163.1: −23% |
| | | | | | | | Second assay not available | Second assay not available |
| LFS49 | 94 | 610 | 159 | 610 | Root | *sorghum* | First assay: | First assay: |
| | | | | | | | Event 8650.1: −2% (not significant, p_value = 0.23) | Event 8650.1: −14% |
| | | | | | | | Event 8653.1: −6% (significant, p_value = 0.01) | Event 8653.1: −40% |
| | | | | | | | Event 8654.1: 1% (not significant, p_value = 0.27) | Event 8654.1: 15% |

TABLE 15-continued

Validation results in *Brachypodium* plant-infected with Fv

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| | | | | | | | Event 8648.1: 9% (significant, p_value = 0.00) | Event 8648.1: 108% |
| | | | | | | | Event 8651.1: 6% (significant, p_value = 0.01) | Event 8651.1: 68% |
| | | | | | | | Second assay: | Second assay: |
| | | | | | | | Event 8653.1: −11% (significant, p_value = 0.01) | Event 8653.1: −53% |
| LFS53 | 98 | 614 | 162 | 614 | Root | *sorghum* | First assay: | First assay: |
| | | | | | | | Event 9634.1: −8% (significant, p_value = 0.00) | Event 9634.1: −44% |
| | | | | | | | Event 8898.1: −12% (significant, p_value = 0.00) | Event 8898.1: −59% |
| | | | | | | | Event 9627.1: −7% (significant, p_value = 0.01) | Event 9627.1: −39% |
| | | | | | | | Event 8186.1: −6% (significant, p_value = 0.02) | Event 8186.1: −38% |
| | | | | | | | Event 9628.1: 2% (not significant, p_value = 0.32) | Event 9628.1: 16% |
| | | | | | | | Second assay: | Second assay: |
| | | | | | | | Event 9634.1: −3% (not significant, p_value = 0.23) | Event 9634.1: −20% |
| | | | | | | | Event 8898.1: 2% (not significant, p_value = 0.31) | Event 8898.1: 16% |
| | | | | | | | Event 9627.1: −2% (not significant, p_value = 0.31) | Event 9627.1: −14% |
| | | | | | | | Event 8186.1: −8% (significant, p_value = 0.03) | Event 8186.1: −44% |
| LFS65 | 107 | 623 | 171 | 623 | Root | *sorghum* | First assay: | First assay: |
| | | | | | | | Event 8368.1: 0% (not significant, p_value = 0.38) | Event 8368.1: 7% |
| | | | | | | | Event 8372.1: 0% (not significant, p_value = 0.41) | Event 8372.1: 6% |
| | | | | | | | Event 8367.1: 3% (not significant, p_value = 0.12) | Event 8367.1: 37% |
| | | | | | | | Event 8376.1: 1% (not significant, p_value = 0.46) | Event 8376.1: 10% |
| | | | | | | | Event 8377.1: 14% (significant, p_value = 0.00) | Event 8377.1: 249% |
| | | | | | | | Second assay not available | Second assay not available |
| LFS70 | 111 | 627 | 175 | 650 | Root | wheat | First assay: | First assay: |
| | | | | | | | Event 8171.1: 0% (not significant, p_value = 0.41) | Event 8171.1: −6% |
| | | | | | | | Event 8181.1: 5% (not significant, p_value = 0.23) | Event 8181.1: 42% |
| | | | | | | | Event 8174.1: 2% (not significant, p_value = 0.34) | Event 8174.1: 21% |
| | | | | | | | Event 8177.1: 6% (not significant, p_value = 0.14) | Event 8177.1: 57% |
| | | | | | | | Event 8179.1: −7% (not significant, p_value = 0.11) | Event 8179.1: −38% |
| | | | | | | | Second assay not available | Second assay not available |
| LFS76 | 117 | 633 | 181 | 633 | Root | wheat | First assay: | First assay: |
| | | | | | | | Event 8619.1: 0% (not significant, p_value = 0.46) | Event 8619.1: 1% |
| | | | | | | | Event 9370.1: 0% (not significant, p_value = 0.49) | Event 9370.1: 1% |
| | | | | | | | Event 8616.1: −10% (significant, p_value = 0.02) | Event 8616.1: −53% |
| | | | | | | | Event 8618.1: 1% (not significant, p_value = 0.39) | Event 8618.1: 15% |
| | | | | | | | Event 8617.1: −2% (not significant, p_value = 0.31) | Event 8617.1: −19% |
| | | | | | | | Second assay: | Second assay: |
| | | | | | | | Event 8619.1: 4% (not significant, p_value = 0.14) | Event 8619.1: −6% |
| | | | | | | | Event 9370.1: 3% (not significant, p_value = 0.23) | Event 9370.1: 33% |
| | | | | | | | Event 8616.1: 3% (not significant, p_value = 0.13) | Event 8616.1: −4% |
| | | | | | | | Event 8618.1: 1% (not significant, p_value = 0.28) | Event 8618.1: 16% |
| | | | | | | | Event 8617.1: −7% (significant, p_value = 0.02) | Event 8617.1: −32% |
| LFS57 | 101 | 617 | 165 | 617 | Root | *sorghum* | First assay: | First assay: |
| | | | | | | | Event 10753.1: −5% (significant, p_value = 0.06) | Event 10753.1: −32% |
| | | | | | | | Event 10752.1: −14% (significant, p_value = 0.00) | Event 10752.1: −60% |
| | | | | | | | Event 10746.1: −3% (not significant, p_value = 0.20) | Event 10746.1: −18% |
| | | | | | | | Event 10747.1: 0% (not significant, p_value = 0.41) | Event 10747.1: 6% |

TABLE 15-continued

Validation results in *Brachypodium* plant-infected with Fv

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| | | | | | | | Event 10754.1: −2% (not significant, p_value = 0.28) | Event 10754.1: −13% |
| | | | | | | | Second assay: | Second assay: |
| | | | | | | | Event 10753.1: 4% (not significant, p_value = 0.11) | Event 10753.1: 32% |
| | | | | | | | Event 10752.1: 5% (significant, p_value = 0.07) | Event 10752.1: 45% |
| LFS10 | 62 | 578 | 128 | 578 | Shoot | barley | First assay: | First assay: |
| | | | | | | | Event 8834.1: −4% (significant, p_value = 0.05) | Event 8834.1: −33% |
| | | | | | | | Event 9351.1: 0% (not significant, p_value = 0.50) | Event 9351.1: 0% |
| | | | | | | | Event 9757.1: −3% (significant, p_value = 0.09) | Event 9757.1: −28% |
| | | | | | | | Event 8838.1: −5% (significant, p_value = 0.02) | Event 8838.1: −43% |
| | | | | | | | Event 8839.1: 0% (not significant, p_value = 0.46) | Event 8839.1: −2% |
| | | | | | | | Second assay: | Second assay: |
| | | | | | | | Event 8834.1: −3% (significant, p_value = 0.08) | Event 8834.1: −31% |
| | | | | | | | Event 9757.1: −1% (not significant, p_value = 0.25) | Event 9757.1: −15% |
| | | | | | | | Event 8838.1: −2% (not significant, p_value = 0.21) | Event 8838.1: −18% |
| LFS14 | 65 | 581 | 131 | 581 | Shoot | maize | First assay: | First assay: |
| | | | | | | | Event 8801.1: 7% (significant, p_value = 0.05) | Event 8801.1: 85% |
| | | | | | | | Event 8802.1: −3% (not significant, p_value = 0.26) | Event 8802.1: −22% |
| | | | | | | | Event 8793.1: −8% (significant, p_value = 0.02) | Event 8793.1: −53% |
| | | | | | | | Event 8797.1: 3% (not significant, p_value = 0.21) | Event 8797.1: 34% |
| | | | | | | | Event 8799.1: 0% (not significant, p_value = 0.45) | Event 8799.1: 1% |
| | | | | | | | Second assay: | Second assay: |
| | | | | | | | Event 8793.1: 3% (not significant, p_value = 0.19) | Event 8793.1: 28% |
| LFS17 | 68 | 584 | 134 | 638 | Root | maize | First assay: | First assay: |
| | | | | | | | Event 9925.1: 11% (significant, p_value = 0.00) | Event 9925.1: 109% |
| | | | | | | | Event 9926.1: −1% (not significant, p_value = 0.34) | Event 9926.1: −9% |
| | | | | | | | Event 9927.1: 6% (significant, p_value = 0.03) | Event 9927.1: 56% |
| | | | | | | | Event 9924.1: 4% (significant, p_value = 0.10) | Event 9924.1: 30% |
| | | | | | | | Event 9928.1: 0% (not significant, p_value = 0.41) | Event 9928.1: 3% |
| | | | | | | | Second assay not available | Second assay not available |
| LFS3 | 56 | 572 | 122 | 572 | Root | barley | First assay: | First assay: |
| | | | | | | | Event 10806.1: −2% (not significant, p_value = 0.19) | Event 10806.1: −17% |
| | | | | | | | Event 10809.1: −3% (significant, p_value = 0.09) | Event 10809.1: −24% |
| | | | | | | | Event 10807.1: −2% (not significant, p_value = 0.13) | Event 10807.1: −19% |
| | | | | | | | Event 10813.1: −5% (significant, p_value = 0.03) | Event 10813.1: −33% |
| | | | | | | | Event 10808.1: −3% (significant, p_value = 0.09) | Event 10808.1: −23% |
| | | | | | | | Second assay: | Second assay: |
| | | | | | | | Event 10809.1: 3% (not significant, p_value = 0.16) | Event 10809.1: 37% |
| | | | | | | | Event 10813.1: −1% (not significant, p_value = 0.27) | Event 10813.1: −16% |
| | | | | | | | Event 10808.1: 1% (not significant, p_value = 0.37) | Event 10808.1: 13% |
| LFS39 | 87 | 603 | 152 | 603 | Shoot | maize | First assay: | First assay: |
| | | | | | | | Event 9444.1: 1% (not significant, p_value = 0.40) | Event 9444.1: 10% |
| | | | | | | | Event 8785.1: 11% (significant, p_value = 0.00) | Event 8785.1: 182% |
| | | | | | | | Event 8893.1: 9% (significant, p_value = 0.00) | Event 8893.1: 139% |
| | | | | | | | Event 8786.1: 2% (not significant, p_value = 0.16) | Event 8786.1: 31% |
| | | | | | | | Event 9443.1: 7% (significant, p_value = 0.00) | Event 9443.1: 101% |
| | | | | | | | Second assay not available | Second assay not available |

TABLE 15-continued

| Validation results in *Brachypodium* plant-infected with Fv | | | | | | | | |
|---|---|---|---|---|---|---|---|---|
| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
| LFS6 | 58 | 574 | 124 | 574 | Root | barley | First assay: | First assay: |
| | | | | | | | Event 9038.1: 12% (significant, p_value = 0.00) | Event 9038.1: 121% |
| | | | | | | | Event 9029.1: 0% (not significant, p_value = 0.47) | Event 9029.1: −3% |
| | | | | | | | Event 9028.1: 17% (significant, p_value = 0.00) | Event 9028.1: 210% |
| | | | | | | | Event 9035.1: 14% (significant, p_value = 0.00) | Event 9035.1: 150% |
| | | | | | | | Event 9032.1: 4% (significant, p_value = 0.09) | Event 9032.1: 34% |
| | | | | | | | Second assay not available | Second assay not available |
| LFS2 | 55 | 571 | 121 | 571 | Shoot | barley | First assay: | First assay: |
| | | | | | | | Event 10688.1: 1% (not significant, p_value = 0.19) | Event 10688.1: 16% |
| | | | | | | | Event 10695.1: 4% (significant, p_value = 0.01) | Event 10695.1: 57% |
| | | | | | | | Event 9442.1: 5% (significant, p_value = 0.01) | Event 9442.1: 62% |
| | | | | | | | Event 10689.1: 0% (not significant, p_value = 0.34) | Event 10689.1: 7% |
| | | | | | | | Event 10690.1: 3% (significant, p_value = 0.05) | Event 10690.1: 37% |
| | | | | | | | Second assay not available | Second assay not available |
| LFS62 | 106 | 622 | 170 | 648 | Root | *sorghum* | First assay: | First assay: |
| | | | | | | | Event 10731.1: −3% (not significant, p_value = 0.15) | Event 10731.1: −20% |
| | | | | | | | Event 10735.1: −9% (significant, p_value = 0.01) | Event 10735.1: −46% |
| | | | | | | | Event 10744.1: −10% (significant, p_value = 0.00) | Event 10744.1: −49% |
| | | | | | | | Event 10738.1: −2% (not significant, p_value = 0.24) | Event 10738.1: −15% |
| | | | | | | | Event 10734.1: 2% (not significant, p_value = 0.25) | Event 10734.1: 20% |
| | | | | | | | Second assay: | Second assay: |
| | | | | | | | Event 10735.1: 7% (significant, p_value = 0.03) | Event 10735.1: 66% |
| | | | | | | | Event 10744.1: 13% (significant, p_value = 0.00) | Event 10744.1: 144% |
| LFS21 | 71 | 587 | 137 | 587 | Shoot | maize | First assay: | First assay: |
| | | | | | | | Event 8583.1: 5% (significant, p_value = 0.02) | Event 8583.1: 75% |
| | | | | | | | Event 8584.1: −1% (not significant, p_value = 0.29) | Event 8584.1: −12% |
| | | | | | | | Event 8586.1: 10% (significant, p_value = 0.00) | Event 8586.1: 142% |
| | | | | | | | Event 8587.1: 1% (not significant, p_value = 0.32) | Event 8587.1: 16% |
| | | | | | | | Event 8585.1: 0% (not significant, p_value = 0.42) | Event 8585.1: 5% |
| | | | | | | | Second assay not available | Second assay not available |
| LFS44 | 90 | 606 | 155 | 606 | Shoot | maize | First assay: | First assay: |
| | | | | | | | Event 11763.1: −3% (significant, p_value = 0.09) | Event 11763.1: −24% |
| | | | | | | | Event 11766.1: 1% (not significant, p_value = 0.38) | Event 11766.1: 14% |
| | | | | | | | Event 11772.1: 0% (not significant, p_value = 0.34) | Event 11772.1: −5% |
| | | | | | | | Event 11774.1: −4% (significant, p_value = 0.03) | Event 11774.1: −34% |
| | | | | | | | Event 11768.1: −10% (significant, p_value = 0.00) | Event 11768.1: −62% |
| | | | | | | | Second assay: | Second assay: |
| | | | | | | | Event 11763.1: 0% (not significant, p_value = 0.42) | Event 11763.1: −5% |
| | | | | | | | Event 11774.1: −2% (not significant, p_value = 0.23) | Event 11774.1: −19% |
| | | | | | | | Event 11768.1: −2% (not significant, p_value = 0.21) | Event 11768.1: −20% |
| LFS9 | 61 | 577 | 127 | 577 | Root | barley | First assay: | First assay: |
| | | | | | | | Event 9049.1: −18% (significant, p_value = 0.00) | Event 9049.1: −73% |
| | | | | | | | Event 9051.1: −9% (significant, p_value = 0.00) | Event 9051.1: −49% |
| | | | | | | | Event 9048.1: −14% (significant, p_value = 0.00) | Event 9048.1: −65% |
| | | | | | | | Event 9054.1: −12% (significant, p_value = 0.00) | Event 9054.1: −57% |
| | | | | | | | Event 9052.1: −11% (significant, p_value = 0.00) | Event 9052.1: −54% |

TABLE 15-continued

Validation results in *Brachypodium* plant-infected with Fv

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| | | | | | | | Second assay: | Second assay: |
| | | | | | | | Event 9049.1: 5% (significant, p_value = 0.10) | Event 9049.1: 45% |
| | | | | | | | Event 9052.1: −2% (not significant, p_value = 0.28) | Event 9052.1: −17% |
| | | | | | | | Event 9051.1: 3% (not significant, p_value = 0.12) | Event 9051.1: 42% |
| | | | | | | | Event 9048.1: −3% (not significant, p_value = 0.15) | Event 9048.1: −26% |
| | | | | | | | Event 9054.1: −4% (significant, p_value = 0.08) | Event 9054.1: −35% |
| LFS18 | 69 | 585 | 135 | 639 | Root | maize | First assay: | First assay: |
| | | | | | | | Event 8826.1: −1% (not significant, p_value = 0.28) | Event 8826.1: −11% |
| | | | | | | | Event 8824.1: −7% (significant, p_value = 0.01) | Event 8824.1: −41% |
| | | | | | | | Event 8827.1: −7% (significant, p_value = 0.01) | Event 8827.1: −41% |
| | | | | | | | Event 8816.1: −8% (significant, p_value = 0.00) | Event 8816.1: −44% |
| | | | | | | | Event 8815.1: −7% (significant, p_value = 0.01) | Event 8815.1: −42% |
| | | | | | | | Second assay: | Second assay: |
| | | | | | | | Event 8824.1: −7% (significant, p_value = 0.01) | Event 8824.1: −46% |
| | | | | | | | Event 8827.1: 0% (not significant, p_value = 0.49) | Event 8827.1: 0% |
| | | | | | | | Event 8816.1: 4% (significant, p_value = 0.10) | Event 8816.1: 45% |
| | | | | | | | Event 8815.1: −4% (significant, p_value = 0.08) | Event 8815.1: −32% |
| LFS30 | 78 | 594 | 143 | 642 | Shoot | maize | First assay: | First assay: |
| | | | | | | | Event 10793.1: −1% (not significant, p_value = 0.37) | Event 10793.1: −8% |
| | | | | | | | Event 10792.1: 1% (not significant, p_value = 0.34) | Event 10792.1: 12% |
| | | | | | | | Event 10796.1: −4% (significant, p_value = 0.07) | Event 10796.1: −34% |
| | | | | | | | Event 10797.1: 0% (not significant, p_value = 0.45) | Event 10797.1: −3% |
| | | | | | | | Event 10794.1: −3% (not significant, p_value = 0.13) | Event 10794.1: −27% |
| | | | | | | | Second assay: | Second assay: |
| | | | | | | | Event 10796.1: −7% (significant, p_value = 0.00) | Event 10796.1: −54% |
| LFS36 | 84 | 600 | 149 | 600 | Shoot | maize | First assay: | First assay: |
| | | | | | | | Event 8814.1: −6% (not significant, p_value = 0.11) | Event 8814.1: −39% |
| | | | | | | | Event 8811.1: −7% (significant, p_value = 0.04) | Event 8811.1: −44% |
| | | | | | | | Event 8809.1: −11% (significant, p_value = 0.01) | Event 8809.1: −56% |
| | | | | | | | Event 8813.1: −2% (not significant, p_value = 0.35) | Event 8813.1: −16% |
| | | | | | | | Event 8806.1: −5% (not significant, p_value = 0.11) | Event 8806.1: −34% |
| | | | | | | | Second assay: | Second assay: |
| | | | | | | | Event 8814.1: −6% (significant, p_value = 0.00) | Event 8814.1: −50% |
| | | | | | | | Event 8811.1: −4% (significant, p_value = 0.01) | Event 8811.1: −42% |
| | | | | | | | Event 8809.1: −6% (significant, p_value = 0.00) | Event 8809.1: −49% |
| | | | | | | | Event 8806.1: −5% (significant, p_value = 0.00) | Event 8806.1: −44% |
| LFS27 | 76 | 592 | 141 | 641 | Root | maize | First assay: | First assay: |
| | | | | | | | Event 8422.1: −6% (significant, p_value = 0.04) | Event 8422.1: −36% |
| | | | | | | | Event 8536.1: −1% (not significant, p_value = 0.32) | Event 8536.1: −9% |
| | | | | | | | Event 8537.1: −2% (not significant, p_value = 0.23) | Event 8537.1: −15% |
| | | | | | | | Event 8420.1: 0% (not significant, p_value = 0.48) | Event 8420.1: 2% |
| | | | | | | | Event 8737.1: −10% (significant, p_value = 0.00) | Event 8737.1: −50% |
| | | | | | | | Event 8739.1: −17% (significant, p_value = 0.00) | Event 8739.1: −69% |
| | | | | | | | Second assay: | Second assay: |
| | | | | | | | Event 8737.1: −8% (significant, p_value = 0.00) | Event 8737.1: −54% |
| | | | | | | | Event 8422.1: −7% (significant, p_value = 0.01) | Event 8422.1: −47% |

TABLE 15-continued

Validation results in *Brachypodium* plant-infected with Fv

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| | | | | | | | Event 8739.1: −2% (not significant, p_value = 0.17) | Event 8739.1: −23% |
| LFS54 | 99 | 615 | 163 | 615 | Root | *sorghum* | First assay: | First assay: |
| | | | | | | | Event 8241.1: 10% (significant, p_value = 0.02) | Event 8241.1: 97% |
| | | | | | | | Event 8240.1: 4% (not significant, p_value = 0.17) | Event 8240.1: 31% |
| | | | | | | | Event 8250.1: 8% (significant, p_value = 0.04) | Event 8250.1: 74% |
| | | | | | | | Event 8249.1: 10% (significant, p_value = 0.02) | Event 8249.1: 97% |
| | | | | | | | Event 8244.1: 4% (not significant, p_value = 0.23) | Event 8244.1: 31% |
| | | | | | | | Event 8246.1: 1% (not significant, p_value = 0.31) | Event 8246.1: 12% |
| | | | | | | | second assay not available | second assay not available |
| LFS46 | 92 | 608 | 157 | 608 | Shoot | *sorghum* | First assay: | First assay: |
| | | | | | | | Event 12016.1: −5% (significant, p_value = 0.06) | Event 12016.1: −38% |
| | | | | | | | Event 12010.1: −5% (significant, p_value = 0.09) | Event 12010.1: −34% |
| | | | | | | | Event 12014.1: −8% (significant, p_value = 0.02) | Event 12014.1: −48% |
| | | | | | | | Event 12019.1: −12% (significant, p_value = 0.00) | Event 12019.1: −64% |
| | | | | | | | Event 12009.1: −17% (significant, p_value = 0.00) | Event 12009.1: −75% |
| | | | | | | | Event 12012.1: 1% (not significant, p_value = 0.40) | Event 12012.1: 9% |
| | | | | | | | Second assay: | Second assay: |
| | | | | | | | Event 12016.1: 0% (not significant, p_value = 0.45) | Event 12016.1: −1% |
| | | | | | | | Event 12010.1: 0% (not significant, p_value = 0.48) | Event 12010.1: 1% |
| | | | | | | | Event 12014.1: 2% (not significant, p_value = 0.19) | Event 12014.1: 24% |
| | | | | | | | Event 12019.1: 0% (not significant, p_value = 0.45) | Event 12019.1: 2% |
| | | | | | | | Event 12009.1: 4% (significant, p_value = 0.03) | Event 12009.1: 53% |
| LFS34 | 82 | 598 | 147 | 598 | Shoot | maize | First assay: | First assay: |
| | | | | | | | Event 10833.1: 6% (not significant, p_value = 0.20) | Event 10833.1: 50% |
| | | | | | | | Event 10828.1: 4% (not significant, p_value = 0.37) | Event 10828.1: 34% |
| | | | | | | | Event 10821.1: 4% (not significant, p_value = 0.87) | Event 10821.1: 2.5% |
| | | | | | | | Event 10830.1: −0.2% (not significant, p_value = 0.9) | Event 10830.1: −1.4% |
| | | | | | | | Event 10832.1: 4% (not significant, p_value = 0.39) | Event 10832.1: −31% |
| | | | | | | | Second assay not available | Second assay not available |
| LFS43 | 89 | 605 | 154 | 644 | Shoot | maize | First assay: | First assay: |
| | | | | | | | Event 10095.1: −1% (not significant, p_value = 0.37) | Event 10095.1: −14% |
| | | | | | | | Event 10094.1: 3% (significant, p_value = 0.06) | Event 10094.1: 36% |
| | | | | | | | Event 10099.1: 4% (significant, p_value = 0.01) | Event 10099.1: 64% |
| | | | | | | | Event 10096.1: 2% (significant, p_value = 0.10) | Event 10096.1: 32% |
| | | | | | | | Event 10098.1: −2% (not significant, p_value = 0.22) | Event 10098.1: −19% |
| | | | | | | | Event 8832.1: 0% (not significant, p_value = 0.44) | Event 8832.1: −4% |
| | | | | | | | Second assay not available | Second assay not available |
| LFS38 | 86 | 602 | 151 | 643 | Root | maize | First assay: | First assay: |
| | | | | | | | Event 12250.1: −3% (not significant, p_value = 0.14) | Event 12250.1: −21% |
| | | | | | | | Event 12252.1: 7% (significant, p_value = 0.00) | Event 12252.1: 68% |
| | | | | | | | Event 12256.1: −1% (not significant, p_value = 0.30) | Event 12256.1: −12% |
| | | | | | | | Event 12254.1: 0% (not significant, p_value = 0.26) | Event 12254.1: 1% |
| | | | | | | | Event 12259.1: 2% (significant, p_value = 0.06) | Event 12259.1: 21% |
| | | | | | | | Event 12258.1: −3% (not significant, p_value = 0.27) | Event 12258.1: −20% |
| | | | | | | | Second assay not available | Second assay not available |

TABLE 15-continued

Validation results in *Brachypodium* plant-infected with Fv

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| LFS25 | 74 | 590 | 139 | 590 | Root | maize | First assay: | First assay: |
| | | | | | | | Event 12524.1: 6% (significant, p_value = 0.01) | Event 12524.1: 82% |
| | | | | | | | Event 12521.1: 8% (significant, p_value = 0.00) | Event 12521.1: 119% |
| | | | | | | | Event 12518.1: 3% (not significant, p_value = 0.18) | Event 12518.1: 34% |
| | | | | | | | Event 12520.1: 6% (significant, p_value = 0.02) | Event 12520.1: 79% |
| | | | | | | | Event 12522.1: 6% (significant, p_value = 0.02) | Event 12522.1: 75% |
| | | | | | | | Event 12526.1: 5% (significant, p_value = 0.04) | Event 12526.1: 69% |
| | | | | | | | Second assay not available | Second assay not available |
| LFS37 | 85 | 601 | 150 | 601 | Root | maize | First assay: | First assay: |
| | | | | | | | Event 10717.1: 1% (not significant, p_value = 0.14) | Event 10717.1: 19% |
| | | | | | | | Event 10724.1: 2% (significant, p_value = 0.05) | Event 10724.1: 22% |
| | | | | | | | Event 10721.1: 1% (not significant, p_value = 0.12) | Event 10721.1: 15% |
| | | | | | | | Event 10719.1: 4% (significant, p_value = 0.01) | Event 10719.1: 45% |
| | | | | | | | Event 10723.1: 0% (not significant, p_value = 0.25) | Event 10723.1: 7% |
| | | | | | | | Second assay not available | Second assay not available |
| LFS55 | 100 | 616 | 164 | 647 | Root | *sorghum* | First assay: | First assay: |
| | | | | | | | Event 10852.1: −5.17% (significant, p_value = 0.01) | Event 10852.1: −41.51% |
| | | | | | | | Event 9958.1: 0.83% (not significant, p_value = 0.37) | Event 9958.1: 9.03% |
| | | | | | | | Event 10854.1: −0.43% (not significant, p_value = 0.41) | Event 10854.1: −4.37% |
| | | | | | | | Event 11761.1: 2.63% (not significant, p_value = 0.13) | Event 11761.1: 31.33% |
| | | | | | | | Event 9955.1: 4.06% (significant, p_value = 0.04) | Event 9955.1: 52.48% |
| | | | | | | | Event 10853.1: −0.25% (not significant, p_value = 0.44) | Event 10853.1: −2.53% |
| | | | | | | | Second assay: | Second assay: |
| | | | | | | | Event 10852.1: 0.01% (not significant, p_value = 0.50) | Event 10852.1: 0.11% |
| LFS50 | 95 | 611 | 160 | 611 | Root | *sorghum* | First assay: | First assay: |
| | | | | | | | Event 10500.1: 3.95% (significant, p_value = 0.00) | Event 10500.1: 52.50% |
| | | | | | | | Event 11037.1: 2.32% (significant, p_value = 0.04) | Event 11037.1: 28.19% |
| | | | | | | | Event 10501.1: 3.03% (significant, p_value = 0.01) | Event 10501.1: 38.17% |
| | | | | | | | Event 11423.1: −2.47% (significant, p_value = 0.04) | Event 11423.1: −23.21% |
| | | | | | | | Event 11035.1: 0.80% (not significant, p_value = 0.35) | Event 11035.1: 8.93% |
| | | | | | | | Event 11033.1: −0.11% (not significant, p_value = 0.44) | Event 11033.1: −1.13% |
| | | | | | | | Second assay: | Second assay: |
| | | | | | | | Event 11423.1: −3.17% (significant, p_value = 0.06) | Event 11423.1: −28.72% |
| LFS19 | 70 | 586 | 136 | 586 | Shoot | maize | First assay: | First assay: |
| | | | | | | | Event 12787.1: −4.45% (significant, p_value = 0.07) | Event 12787.1: −34.30% |
| | | | | | | | Event 12785.1: −5.77% (significant, p_value = 0.03) | Event 12785.1: −42.00% |
| | | | | | | | Event 12937.1: −3.25% (not significant, p_value = 0.15) | Event 12937.1: −26.44% |
| | | | | | | | Event 12786.1: 4.82% (significant, p_value = 0.04) | Event 12786.1: −36.54% |
| | | | | | | | Event 12943.1: −5.97% (significant, p_value = 0.03) | Event 12943.1: −43.07% |
| | | | | | | | Event 12942.1: 1.57% (not significant, p_value = 0.31) | Event 12942.1: 15.92% |
| | | | | | | | Second assay: | Second assay: |
| | | | | | | | Event 12787.1: −8.93% (significant, p_value = 0.00) | Event 12787.1: −59.42% |
| | | | | | | | Event 12785.1: 4.27% (significant, p_value = 0.09) | Event 12785.1: −35.00% |
| | | | | | | | Event 12786.1: 4.83% (significant, p_value = 0.06) | Event 12786.1: −38.61% |
| | | | | | | | Event 12943.1: −10.98% (significant, p_value = 0.00) | Event 12943.1: −67.01% |

TABLE 15-continued

Validation results in *Brachypodium* plant-infected with Fv

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| LFS29 | 77 | 593 | 142 | 593 | Root | maize | First assay: | First assay: |
| | | | | | | | Event 12563.1: −7.71% (significant, p_value = 0.00) | Event 12563.1: −56.61% |
| | | | | | | | Event 12779.1: −6.40% (significant, p_value = 0.00) | Event 12779.1: −49.98% |
| | | | | | | | Event 13347.1: 1.16% (not significant, p_value = 0.32) | Event 13347.1: 13.37% |
| | | | | | | | Event 13346.1: 4.35% (significant, p_value = 0.02) | Event 13346.1: −37.59% |
| | | | | | | | Event 12561.1: 2.54% (significant, p_value = 0.09) | Event 12561.1: 31.71% |
| | | | | | | | Event 12780.1: −3.07% (significant, p_value = 0.08) | Event 12780.1: −28.32% |
| | | | | | | | Second assay: | Second assay: |
| | | | | | | | Event 12780.1: −11.66% (significant, p_value = 0.00) | Event 12780.1: −71.22% |
| | | | | | | | Event 13346.42: −25.14% (significant, p_value = 0.00) | Event 13346.42: −91.71% |
| | | | | | | | Event 12779.38: 1.53% (not significant, p_value = 0.32) | Event 12779.38: 16.40% |
| LFS72 | 113 | 629 | 177 | 651 | Root | wheat | First assay: | First assay: |
| | | | | | | | Event 10781.1: −9.57% (significant, p_value = 0.00) | Event 10781.1: −65.49% |
| | | | | | | | Event 10779.1: −6.72% (significant, p_value = 0.00) | Event 10779.1: −52.62% |
| | | | | | | | Event 10784.1: −5.21% (significant, p_value = 0.01) | Event 10784.1: −43.95% |
| | | | | | | | Event 10786.1: −1.71% (not significant, p_value = 0.19) | Event 10786.1: −17.28% |
| | | | | | | | Event 10783.1: −5.94% (significant, p_value = 0.00) | Event 10783.1: −48.34% |
| | | | | | | | Event 10790.1: −3.01% (not significant, p_value = 0.13) | Event 10790.1: −28.42% |
| | | | | | | | Second assay: | Second assay: |
| | | | | | | | Event 10781.1: −3.66% (significant, p_value = 0.04) | Event 10781.1: −32.33% |
| | | | | | | | Event 10779.1: −12.17% (significant, p_value = 0.00) | Event 10779.1: −72.73% |
| | | | | | | | Event 10784.1: −1.12% (not significant, p_value = 0.29) | Event 10784.1: −11.30% |
| | | | | | | | Event 10783.1: −7.43% (significant, p_value = 0.00) | Event 10783.1: −54.77% |
| LFS8 | 60 | 576 | 126 | 576 | Shoot | barley | First assay: | First assay: |
| | | | | | | | Event 12200.1: −3.19% (significant, p_value = 0.03) | Event 12200.1: −30.68% |
| | | | | | | | Event 12035.1: 0.06% (not significant, p_value = 0.46) | Event 12035.1: 0.66% |
| | | | | | | | Event 12199.1: −3.72% (significant, p_value = 0.01) | Event 12199.1: −34.80% |
| | | | | | | | Event 11146.1: 1.15% (not significant, p_value = 0.20) | Event 11146.1: 14.15% |
| | | | | | | | Event 11762.1: −0.29% (not significant, p_value = 0.36) | Event 11762.1: −3.28% |
| | | | | | | | Event 12197.1: −0.26% (not significant, p_value = 0.41) | Event 12197.1: −2.94% |
| | | | | | | | Second assay: | Second assay: |
| | | | | | | | Event 12200.1: −8.04% (significant, p_value = 0.01) | Event 12200.1: −53.79% |
| | | | | | | | Event 12199.1: −3.85% (not significant, p_value = 0.12) | Event 12199.1: −30.91% |
| LFS78 | 119 | 635 | 183 | 654 | Shoot | wheat | First assay: | First assay: |
| | | | | | | | Event 11698.1: −10.05% (significant, p_value = 0.00) | Event 11698.1: −67.08% |
| | | | | | | | Event 11703.1: −0.17% (not significant, p_value = 0.47) | Event 11703.1: −1.90% |
| | | | | | | | Event 11704.1: −2.41% (not significant, p_value = 0.14) | Event 11704.1: −23.37% |
| | | | | | | | Event 11701.1: −3.50% (significant, p_value = 0.07) | Event 11701.1: −32.07% |
| | | | | | | | Event 11699.1: −2.50% (not significant, p_value = 0.16) | Event 11699.1: −24.15% |
| | | | | | | | Event 11702.1: 4.13% (significant, p_value = 0.02) | Event 11702.1: 57.85% |
| | | | | | | | Second assay: | Second assay: |
| | | | | | | | Event 11698.1: 1.92% (not significant, p_value = 0.23) | Event 11698.1: 20.21% |
| | | | | | | | Event 11701.1: −6.19% (significant, p_value = 0.01) | Event 11701.1: −44.79% |
| LFS45 | 91 | 607 | 156 | 607 | Root | *sorghum* | First assay: | First assay: |
| | | | | | | | Event 11079.1: −3.81% (significant, p_value = 0.01) | Event 11079.1: −35.24% |
| | | | | | | | Event 11081.1: −7.11% (significant, p_value = 0.00) | Event 11081.1: −55.57% |

TABLE 15-continued

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| Validation results in *Brachypodium* plant-infected with Fv | | | | | | | | |
| | | | | | | | Event 11078.1: −3.73% (significant, p_value = 0.02) | Event 11078.1: −34.70% |
| | | | | | | | Event 11080.1: −8.62% (significant, p_value = 0.00) | Event 11080.1: −62.60% |
| | | | | | | | Event 11074.1: −10.72% (significant, p_value = 0.00) | Event 11074.1: −70.58% |
| | | | | | | | Event 11076.1: −2.45% (significant, p_value = 0.08) | Event 11076 l· -24 36% |
| | | | | | | | Second assay: | Second assay: |
| | | | | | | | Event 11079.1: −9.42% (significant, p_value = 0.00) | Event 11079.1: −61.55% |
| | | | | | | | Event 11081.1: 1.53% (not significant, p_value = 0.27) | Event 11081.1: 16.77% |
| | | | | | | | Event 11078.1: 0.96% (not significant, p_value = 0.29) | Event 11078.1: 10.21% |
| | | | | | | | Event 11080.1: −3.12% (significant, p_value = 0.07) | Event 11080.1: −27.17% |
| | | | | | | | Event 11074.1: −5.55% (significant, p_value = 0.00) | |
| | | | | | | | Event 11076.1: 1.82% (not significant, p_value = 0.28) | |
| LFS31 | 79 | 595 | 144 | 595 | Root | maize | First assay: | First assay: |
| | | | | | | | Event 8900.1: 12.65% (significant, p_value = 0.01) | Event 8900.1: 105.62% |
| | | | | | | | Event 9296.1: 3.56% (not significant, p_value = 0.28) | Event 9296.1: 22.47% |
| | | | | | | | Event 9300.1: 13.98% (significant, p_value = 0.01) | Event 9300.1: 121.81% |
| | | | | | | | Event 8657.1: 6.30% (not significant, p_value = 0.13) | Event 8657.1: 43.18% |
| | | | | | | | Event 9301.1: 5.51% (not significant, p_value = 0.17) | Event 9301.1: 36.89% |
| | | | | | | | Event 8658.1: 4.14% (not significant, p_value = 0.24) | Event 8658.1: 26.60% |
| | | | | | | | Second assay not available | Second assay not available |
| LFS60 | 104 | 620 | 168 | 620 | Root | *sorghum* | First assay: | First assay: |
| | | | | | | | Event 12264.1: 38.50% (significant, p_value = 0.00) | Event 12264.1: 1663.38% |
| | | | | | | | Event 12841.1: 38.63% (significant, p_value = 0.00) | Event 12841.1: 1681.62% |
| | | | | | | | Event 12037.1: 25.32% (significant, p_value = 0.00) | Event 12037.1: 560.29% |
| | | | | | | | Event 12265.1: 41.28% (significant, p_value = 0.00) | Event 12265.1: 2070.79% |
| | | | | | | | Event 12837.1: 50.93% (significant, p_value = 0.00) | Event 12837.1: 4356.04% |
| | | | | | | | Event 12843.1: 37.47% (significant, p_value = 0.00) | Event 12843.1: 1533.31% |
| | | | | | | | Second assay not available | Second assay not available |
| LFS42 | 88 | 604 | 153 | 604 | Root | maize | First assay: | First assay: |
| | | | | | | | Event 9225.1: −0.46% (not significant, p_value = 0.48) | Event 9225.1: −4.71% |
| | | | | | | | Event 9369.1: −2.59% (significant, p_value = 0.06) | Event 9369.1: −23.74% |
| | | | | | | | Event 9623.1: −1.75% (not significant, p_value = 0.14) | Event 9623.1: −16.71% |
| | | | | | | | Event 9624.1: −1.52% (not significant, p_value = 0.23) | Event 9624.1: −14.64% |
| | | | | | | | Event 9228.1: −4.82% (significant, p_value = 0.00) | Event 9228.1: −39.54% |
| | | | | | | | Event 9224.1: −1.39% (not significant, p_value = 0.19) | Event 9224.1: −13.55% |
| | | | | | | | Second assay: | Second assay: |
| | | | | | | | Event 9369.1: −1.22% (not significant, p_value = 0.28) | Event 9369.1: −12.31% |
| | | | | | | | Event 9228.1: 1.83% (not significant, p_value = 0.23) | Event 9228.1: 21.92% |
| LFS7 | 59 | 575 | 125 | 575 | Root | barley | First assay: | First assay: |
| | | | | | | | Event 9276.1: −1.72% (not significant, p_value = 0.14) | Event 9276.1: −16.23% |
| | | | | | | | Event 9283.1: −5.45% (significant, p_value = 0.00) | Event 9283.1: −43.03% |
| | | | | | | | Event 9284.1: 3.29% (significant, p_value = 0.02) | Event 9284.1: 40.44% |
| | | | | | | | Event 9286.1: −2.43% (significant, p_value = 0.07) | Event 9286.1: −22.17% |
| | | | | | | | Event 9274.1: 2.01% (not significant, p_value = 0.12) | Event 9274.1: 23.02% |
| | | | | | | | Event 9280.1: 0.09% (not significant, p_value = 0.45) | Event 9280.1: 0.89% |
| | | | | | | | Second assay: | Second assay: |

TABLE 15-continued

Validation results in *Brachypodium* plant-infected with Fv

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| | | | | | | | Event 9283.1: −13.90% (significant, p_value = 0.00) | Event 9283.1: −77.74% |
| | | | | | | | Event 9286.1: −2.66% (not significant, p_value = 0.13) | Event 9286.1: −24.98% |
| LFS40 | 530 | 941 | 535 | 941 | Root | maize | First assay: | First assay: |
| | | | | | | | Event 11575.1: 3.80% (significant, p_value = 0.07) | Event 11575.1: 47.21% |
| | | | | | | | Event 11586.1: −7.26% (significant, p_value = 0.00) | Event 11586.1: −52.20% |
| | | | | | | | Event 11574.1: −0.45% (not significant, p_value = 0.43) | Event 11574.1: −4.44% |
| | | | | | | | Event 11576.1: 0.79% (not significant, p_value = 0.37) | Event 11576.1: 8.34% |
| | | | | | | | Event 11580.1: −3.16% (not significant, p_value = 0.11) | Event 11580.1: −27.50% |
| | | | | | | | Event 11577.1: −1.64% (not significant, p_value = 0.26) | Event 11577.1: −15.36% |
| | | | | | | | Second assay: | Second assay: |
| | | | | | | | Event 11586.1: −11.50% (significant, p_value = 0.00) | Event 11586.1: −71.15% |
| LFS4 | 57 | 573 | 123 | 573 | Root | barley | First assay: | First assay: |
| | | | | | | | Event 9066.1: 2.69% (not significant, p_value = 0.12) | Event 9066.1: 30.17% |
| | | | | | | | Event 9070.1: −6.08% (significant, p_value = 0.00) | Event 9070.1: −44.83% |
| | | | | | | | Event 9069.1: −10.04% (significant, p_value = 0.00) | Event 9069.1: −62.58% |
| | | | | | | | Event 9071.1: −11.52% (significant, p_value = 0.00) | Event 9071.1: −67.60% |
| | | | | | | | Event 9074.1: −16.56% (significant, p_value = 0.00) | Event 9074.1: −80.23% |
| | | | | | | | Event 9075.1: −10.20% (significant, p_value = 0.00) | Event 9075.1: −63.16% |
| | | | | | | | Second assay: | Second assay: |
| | | | | | | | Event 9070.1: 0.66% (not significant, p_value = 0.31) | Event 9070.1: 5.87% |
| | | | | | | | Event 9069.1: −4.88% (significant, p_value = 0.00) | Event 9069.1: −34.37% |
| | | | | | | | Event 9071.1: −4.22% (significant, p_value = 0.00) | Event 9071.1: −30.56% |
| | | | | | | | Event 9074.1: −3.92% (significant, p_value = 0.00) | Event 9074.1: −28.75% |
| | | | | | | | | Event 9075.1: −27.28% |
| LFS35 | 83 | 599 | 148 | 599 | Shoot | maize | First assay: | First assay: |
| | | | | | | | Event 12796.1: 4.74% (significant, p_value = 0.02) | Event 12796.1: 58.04% |
| | | | | | | | Event 12794.1: 2.15% (not significant, p_value = 0.22) | Event 12794.1: 23.12% |
| | | | | | | | Event 12797.1: 7.54% (significant, p_value = 0.00) | Event 12797.1: 106.95% |
| | | | | | | | Event 12964.1: 1.83% (not significant, p_value = 0.22) | Event 12964.1: 19.28% |
| | | | | | | | Event 12965.1: 0.46% (not significant, p_value = 0.36) | Event 12965.1: 4.59% |
| | | | | | | | Event 12793.1: −8.28% (significant, p_value = 0.00) | Event 12793.1: −55.01% |
| | | | | | | | Second assay: | Second assay: |
| | | | | | | | Event 12793.1: 3.02% (not significant, p_value = 0.14) | Event 12793.1: 32.61% |
| LFS80 | 120 | 636 | 184 | 636 | Root | maize | First assay: | First assay: |
| | | | | | | | Event 10837.1: −2.72% (not significant, p_value = 0.20) | Event 10837.1: −23.54% |
| | | | | | | | Event 10841.1: 1.21% (not significant, p_value = 0.32) | Event 10841.1: 12.72% |
| | | | | | | | Event 10843.1: 2.73% (not significant, p_value = 0.18) | Event 10843.1: 30.98% |
| | | | | | | | Event 10839.1: 9.36% (significant, p_value = 0.00) | Event 10839.1: 151.85% |
| | | | | | | | Event 10848.1: 2.41% (not significant, p_value = 0.21) | Event 10848.1: 26.87% |
| | | | | | | | Event 10838.1: 3.59% (not significant, p_value = 0.10) | Event 10838.1: 42.56% |
| | | | | | | | Second assay not available | Second assay not available |
| LFS47 | 93 | 609 | 158 | 645 | Shoot | *sorghum* | First assay: | First assay: |
| | | | | | | | Event 9208.1: −4.08% (significant, p_value = 0.08) | Event 9208.1: −33.17% |
| | | | | | | | Event 9217.1: −7.42% (significant, p_value = 0.00) | Event 9217.1: −51.90% |
| | | | | | | | Event 9209.1: −2.32% (not significant, p_value = 0.18) | Event 9209.1: −20.45% |
| | | | | | | | Event 9215.1: −2.76% (not significant, p_value = 0.16) | Event 9215.1: −23.87% |

TABLE 15-continued

Validation results in *Brachypodium* plant-infected with Fv

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| | | | | | | | Event 9216.1: −9.22% (significant, p_value = 0.00)<br>Event 9211.1: −5.62% (significant, p_value = 0.02)<br>Second assay:<br>Event 9208.1: 3.21% (not significant, p_value = 0.11)<br>Event 9217.1: 2.39% (not significant, p_value = 0.16)<br>Event 9216.1: −7.36% (significant, p_value = 0.00)<br>Event 9211.1: 1.53% (not significant, p_value = 0.29) | Event 9216.1: −59.73%<br>Event 9211.1: −42.58%<br>Second assay:<br>Event 9208.1: 41.38%<br>Event 9217.1: 29.33%<br>Event 9216.1: −54.75%<br>Event 9211.1: 17.88% |
| LFS48 | 531 | 942 | 536 | 943 | Root | *sorghum* | First assay:<br>Event 10858.1: −4.30% (significant, p_value = 0.01)<br>Event 10859.1: −3.77% (significant, p_value = 0.01)<br>Event 10860.1: 0.77% (not significant, p_value = 0.26)<br>Event 10862.1: 1.95% (not significant, p_value = 0.14)<br>Event 11734.1: −6.25% (significant, p_value = 0.00)<br>Event 10856.1: 1.87% (not significant, p_value = 0.11)<br>Second assay:<br>Event 10858.1: 2.94% (significant, p_value = 0.03)<br>Event 10859.1: −1.88% (not significant, p_value = 0.11)<br>Event 11734.1: −2.76% (significant, p_value = 0.03) | First assay:<br>Event 10858.1: −34.89%<br>Event 10859.1: −31.32%<br>Event 10860.1: 7.97%<br>Event 10862.1: 21.51%<br>Event 11734.1: −46.41%<br>Event 10856.1: 20.51%<br>Second assay:<br>Event 10858.1: 36.73%<br>Event 10859.1: −18.17%<br>Event 11734.1: −25.46% |
| LFS52 | 97 | 613 | 161 | 646 | Root | *sorghum* | First assay:<br>Event 10031.1: 3.05% (significant, p_value = 0.02)<br>Event 10033.1: 3.31% (significant, p_value = 0.02)<br>Event 10023.1: 1.01% (not significant, p_value = 0.24)<br>Event 10026.1: −0.96% (not significant, p_value = 0.29)<br>Event 10024.1: 0.73% (not significant, p_value = 0.31)<br>Event 10029.1: 4.06% (significant, p_value = 0.00)<br>Second assay not available | First assay:<br>Event 10031.1: 39.80%<br>Event 10033.1: 43.98%<br>Event 10023.1: 11.76%<br>Event 10026.1: −10.02%<br>Event 10024.1: 8.37%<br>Event 10029.1: 56.33%<br>Second assay not available |
| LFS59 | 103 | 619 | 167 | 619 | Shoot | *sorghum* | First assay:<br>Event 11793.1: 8.19% (significant, p_value = 0.00)<br>Event 11797.1: 5.59% (significant, p_value = 0.02)<br>Event 11799.1: −0.48% (not significant, p_value = 0.44)<br>Event 11794.1: 3.94% (significant, p_value = 0.07)<br>Event 11798.1: 11.76% (significant, p_value = 0.00)<br>Event 11802.1: 7.28% (significant, p_value = 0.00)<br>Second assay not available | First assay:<br>Event 11793.1: 121.77%<br>Event 11797.1: 72.11%<br>Event 11799.1: −4.51%<br>Event 11794.1: 46.67%<br>Event 11798.1: 213.69%<br>Event 11802.1: 102.93%<br>Second assay not available |
| LFS45 | 91 | 607 | 156 | 607 | Root | *sorghum* | First assay:<br>Event 11079.1: −3.81% (significant, p_value = 0.01)<br>Event 11081.1: −7.11% (significant, p_value = 0.00)<br>Event 11078.1: −3.73% (significant, p_value = 0.02)<br>Event 11080.1: −8.62% (significant, p_value = 0.00)<br>Event 11074.1: −10.72% (significant, p_value = 0.00)<br>Event 11076.1: −2.45% (significant, p_value = 0.08)<br>Second assay:<br>Event 11079.1: −9.42% (significant, p_value = 0.00)<br>Event 11081.1: 1.53% (not significant, p_value = 0.27)<br>Event 11078.1: 0.96% (not significant, p_value = 0.29)<br>Event 11080.1: −3.12% (significant, p_value = 0.07) | First assay:<br>Event 11079.1: −35.24%<br>Event 11081.1: −55.57%<br>Event 11078.1: −34.70%<br>Event 11080.1: −62.60%<br>Event 11074.1: −70.58%<br>Event 11076.1: −24.36%<br>Second assay:<br>Event 11079.1: −61.55%<br>Event 11081.1: 16.77%<br>Event 11078.1: 10.21%<br>Event 11080.1: −27.17% |

TABLE 15-continued

Validation results in *Brachypodium* plant-infected with Fv

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| | | | | | | | | Event 11074.1: −43.09% |
| | | | | | | | | Event 11076.1: 20.29% |
| LFS66 | 108 | 624 | 172 | 624 | shoot | *sorghum* | First assay: | First assay: |
| | | | | | | | Event 11559.1: 3.64% (not significant, p_value = 0.15) | Event 11559.1: 44.61% |
| | | | | | | | Event 11565.1: 5.23% (significant, p_value = 0.07) | Event 11565.1: 69.76% |
| | | | | | | | Event 11558.1: 2.04% (not significant, p_value = 0.26) | Event 11558.1: 22.98% |
| | | | | | | | Event 11564.1: −2.14% (not significant, p_value = 0.22) | Event 11564.1: −19.44% |
| | | | | | | | Event 11563.1: 4.70% (significant, p_value = 0.09) | Event 11563.1: 60.89% |
| | | | | | | | Event 11568.1: 6.82% (significant, p_value = 0.02) | Event 11568.1: 99.43% |
| | | | | | | | Second assay not available | Second assay not available |
| LFS67 | 109 | 625 | 173 | 625 | Shoot | wheat | First assay: | First assay: |
| | | | | | | | Event 12003.1: −0.70% (not significant, p_value = 0.33) | Event 12003.1: −7.10% |
| | | | | | | | Event 11997.1: −3.53% (significant, p_value = 0.08) | Event 11997.1: −31.14% |
| | | | | | | | Event 12000.1: 1.29% (not significant, p_value = 0.25) | Event 12000.1: 14.58% |
| | | | | | | | Event 12005.1: 8.21% (significant, p_value = 0.00) | Event 12005.1: 137.95% |
| | | | | | | | Event 12001.1: 2.38% (not significant, p_value = 0.24) | Event 12001.1: 28.52% |
| | | | | | | | Event 12004.1: 4.32% (significant, p_value = 0.04) | Event 12004.1: 57.75% |
| | | | | | | | Second assay: | Second assay: |
| | | | | | | | Event 11997.1: 0.27% (not significant, p_value = 0.37) | Event 11997.1: 2.51% |
| LFS68 | 110 | 626 | 174 | 649 | Root | wheat | First assay: | First assay: |
| | | | | | | | Event 9938.1: 5.69% (significant, p_value = 0.00) | Event 9938.1: 74.07% |
| | | | | | | | Event 9940.1: 3.60% (significant, p_value = 0.03) | Event 9940.1: 42.02% |
| | | | | | | | Event 9944.1: 0.02% (not significant, p_value = 0.50) | Event 9944.1: 0.16% |
| | | | | | | | Event 9946.1: 4.13% (significant, p_value = 0.01) | Event 9946.1: 49.46% |
| | | | | | | | Event 9939.1: 4.40% (significant, p_value = 0.01) | Event 9939.1: 53.41% |
| | | | | | | | Event 9943.1: 4.84% (significant, p_value = 0.00) | Event 9943.1: 60.23% |
| | | | | | | | Second assay not available | Second assay not available |
| LFS73 | 114 | 630 | 178 | 652 | Shoot | wheat | First assay: | First assay: |
| | | | | | | | Event 12447.1: −10.00% (significant, p_value = 0.00) | Event 12447.1: −66.37% |
| | | | | | | | Event 12438.1: 0.90% (not significant, p_value = 0.40) | Event 12438.1: 10.34% |
| | | | | | | | Event 12441.1: −5.26% (significant, p_value = 0.01) | Event 12441.1: −43.64% |
| | | | | | | | Event 12439.1: 3.04% (not significant, p_value = 0.10) | Event 12439.1: 39.30% |
| | | | | | | | Event 12443.1: −12.28% (significant, p_value = 0.00) | Event 12443.1: −73.74% |
| | | | | | | | Event 12448.1: −8.18% (significant, p_value = 0.00) | Event 12448.1: −58.97% |
| | | | | | | | Second assay: | Second assay: |
| | | | | | | | Event 12447.1: −7.05% (significant, p_value = 0.03) | Event 12447.1: −48.30% |
| | | | | | | | Event 12441.1: −11.43% (significant, p_value = 0.00) | Event 12441.1: −65.70% |
| | | | | | | | Event 12443.1: −2.68% (not significant, p_value = 0.25) | Event 12443.1: −22.20% |
| | | | | | | | Event 12448.1: −3.59% (not significant, p_value = 0.15) | Event 12448.1: −28.52% |
| LFS74 | 115 | 631 | 179 | 631 | Shoot | wheat | First assay: | First assay: |
| | | | | | | | Event 10863.1: 18.55% (significant, p_value = 0.00) | Event 10863.1: 375.05% |
| | | | | | | | Event 10866.1: 16.55% (significant, p_value = 0.00) | Event 10866.1: 301.62% |
| | | | | | | | Event 10869.1: 13.76% (significant, p_value = 0.00) | Event 10869.1: 217.85% |
| | | | | | | | Event 10874.1: 10.91% (significant, p_value = 0.00) | Event 10874.1: 150.20% |
| | | | | | | | Event 10873.1: −7.22% (significant, p_value = 0.02) | Event 10873.1: −45.48% |

TABLE 15-continued

Validation results in *Brachypodium* plant-infected with Fv

| Gene Name | Polyn. SEQ ID NO: | Polyp. SEQ ID NO: | Polyn. SEQ ID NO: (Cloned) | Polyp. SEQ ID NO: (cloned) | Organ in Assay | Origin of Hit | % Reduction logCFU (p-value) | % Reduction CFU |
|---|---|---|---|---|---|---|---|---|
| | | | | | | | Event 10867.1: 6.43% (significant, p_value = 0.05)<br>Second assay:<br>Event 10873.1: −6.84% (significant, p_value = 0.01) | Event 10867.1: 71.60%<br>Second assay:<br>Event 10873.1: −52.14% |
| LFS75 | 116 | 632 | 180 | 653 | Shoot | wheat | First assay:<br>Event 10762.1: 5.06% (significant, p_value = 0.01)<br>Event 10772.1: −6.86% (significant, p_value = 0.00)<br>Event 10764.1: −0.27% (not significant, p_value = 0.48)<br>Event 10773.1: 1.39% (not significant, p_value = 0.26)<br>Event 10761.1: −3.37% (significant, p_value = 0.07)<br>Event 10769.1: −9.82% (significant, p_value = 0.00)<br>Second assay:<br>Event 10772.1: −3.66% (significant, p_value = 0.08)<br>Event 10761.1: −6.63% (significant, p_value = 0.01)<br>Event 10769.1: −0.61% (not significant, p_value = 0.47) | First assay:<br>Event 10762.1: 68.46%<br>Event 10772.1: −50.68%<br>Event 10764.1: −2.78%<br>Event 10773.1: 15.45%<br>Event 10761.1: −29.35%<br>Event 10769.1: −63.64%<br>Second assay:<br>Event 10772.1: −32.56%<br>Event 10761.1: −47.10%<br>Event 10769.1: −5.69% |
| LFS77 | 118 | 634 | 182 | 634 | Root | wheat | First assay:<br>Event 9907.1: 5.67% (significant, p_value = 0.00)<br>Event 9902.1: −0.91% (not significant, p_value = 0.34)<br>Event 9898.1: 14.39% (significant, p_value = 0.00)<br>Event 9906.1: 2.19% (not significant, p_value = 0.15)<br>Event 9904.1: 10.71% (significant, p_value = 0.00)<br>Event 9900.1: 9.51% (significant, p_value = 0.00)<br>Second assay not available | First assay:<br>Event 9907.1: 73.28%<br>Event 9902.1: −8.48%<br>Event 9898.1: 303.40%<br>Event 9906.1: 23.64%<br>Event 9904.1: 182.45%<br>Event 9900.1: 151.50%<br>Second assay not available |
| LFS71 | 112 | 628 | 176 | 628 | Root | wheat | First assay:<br>Event 12464.1: 4.33% (significant, p_value = 0.01)<br>Event 12453.1: −0.92% (not significant, p_value = 0.32)<br>Event 12461.1: −4.61% (significant, p_value = 0.01)<br>Event 12460.1: 6.69% (significant, p_value = 0.00)<br>Event 12462.1: −1.10% (not significant, p_value = 0.28)<br>Event 12463.1: 4.02% (significant, p_value = 0.02)<br>Second assay:<br>Event 12463.1: 3.02% (significant, p_value = 0.03)<br>Event 12461.1: −1.30% (not significant, p_value = 0.29) | First assay:<br>Event 12464.1: 54.38%<br>Event 12453.1: −8.83%<br>Event 12461.1: −37.07%<br>Event 12460.1: 95.77%<br>Event 12462.1: −10.42%<br>Event 12463.1: −33.18%<br>Second assay:<br>Event 12463.1: 37.82%<br>Event 12461.1: −13.14% |

"Polyn." = Polynucleotide;
"Polyp." = Polypeptide;
"CFU" = Colony Forming Unit

Example 8: Overexpression of a Polypeptide by Genome Editing

Over-expression of a polypeptide according to certain embodiments of the present invention can be achieved using methods of gene editing. One example of such approach includes editing a selected genomic region as to express the polypeptide of interest. In the current example, the target genomic region is the maize locus GRMZM2G069095 (based on genome version *Zea mays* AGPv3) and the polypeptide to be over-expressed is the maize LFS24 comprising the amino acid sequence set forth in SEQ ID NO:589 encoded by the polynucleotide having the nucleic acid sequence set forth in SEQ ID NO:138. It is to be explicitly understood that other genome loci can be used as targets for genome editing for over-expressing other polypeptides of the invention based on the same principles.

FIG. 4A depicts the sequence of the endogenous 5' upstream flanking region of the genomic sequence GRMZM2G069095 (SEQ ID NO:45) and FIG. 4B depicts the sequence of the endogenous 3'-downstream flanking region of this genomic locus (SEQ ID NO:46). FIG. 4C depicts the sequence of the 5'-UTR gRNA (SEQ ID NO:43) and FIG. 4D depicts the sequence of the 5'-UTR gRNA without NGG nucleotides following the 3 nucleotides after the Cas9 cutting (SEQ ID NO:47). FIG. 4E depicts the sequence of the 3'-UTR gRNA (SEQ ID NO:44) and FIG. 4F depicts the sequence of the 3'-UTR gRNA after cut (SEQ ID NO:48). FIG. 4G depicts the coding sequence (from the "ATG" start codon to the "TGA" termination codon, marked by bold and underlined) of the desired LFS24 sequence (SEQ ID NO:50) encoding the polypeptide set forth by SEQ ID NO: 589.

The complete exemplary repair template (SEQ ID NO:49) is depicted in FIG. 4H. The repair template includes: (1) the upstream flanking region (1 kbp) sequence including part of the gRNA after cutting (SEQ ID NO:47; shown in bold and italics); (2) 5' UTR of genomic DNA from Cas9 cutting site to ATG; (3) the coding sequence (CDS) of the desired LFS24 sequence (SEQ ID NO:50) marked in lower case with the start (ATG) and the stop (TGA) codons marked in bold and underlined; (4) 3' UTR of genomic DNA from the stop codon to Cas9 cutting site including the predicted part of the gRNA after cutting (SEQ ID NO:48), shown in bold and italics and (5) the downstream flanking region (1 kbp) sequence.

The repair template is delivered into the cell type of interest along with the 5' and 3' guide RNA sequences (SEQ ID NO:43 and SEQ ID NO:44, respectively).

Example 9: Knockout of a Polypeptide by Genome Editing

Knock-out of a polypeptide according to certain embodiments of the present invention can be achieved using methods of gene editing.

In the current example, the target genomic region is the maize LFS39 protein comprising the amino acid sequence set forth in SEQ ID NO:603 encoded by the polynucleotide having the nucleic acid sequence set forth in SEQ ID NO:53. It is to be explicitly understood that other genome loci can be used as targets for genome editing for over-expressing other polypeptides of the invention based on the same principles.

The CRISPR/CAS9 or similar systems can generate double stranded breaks (DSBs) at any genomic locus under the guidance of an engineered single-guide RNA when delivered into the cell type of interest. Non-homologous end-joining (NHEJ) in the absence of DNA template accompanied with the modification of target genomic repair the DSBs but tends to be prone to insertion and/or deletion (indel) mutations at the junctional site, causing frame shifts mutations that disrupt the targeted gene. (FIG. 5E)

The foregoing description of the specific embodiments will so fully reveal the general nature of the invention that others can, by applying current knowledge, readily modify and/or adapt for various applications such specific embodiments without undue experimentation and without departing from the generic concept, and, therefore, such adaptations and modifications should and are intended to be comprehended within the meaning and range of equivalents of the disclosed embodiments. It is to be understood that the phraseology or terminology employed herein is for the purpose of description and not of limitation. The means, materials, and steps for carrying out various disclosed functions may take a variety of alternative forms without departing from the invention.

SEQUENCE LISTING (1129 sequences)

SEQ ID NO: 1 - DNA, 2000 bp, Wheat
  Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 2 - DNA, 1919 bp, Wheat
  misc_feature (1306)..(1316): n is a, c, g, or t
  misc_feature (1649)..(1649): n is a, c, g, or t
  Wheat LMW Longer Promoter
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 3 - DNA, 326 bp, Wheat
  misc_feature (56)..(56): n is a, c, g, or t
  Wheat LMW Promoter
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 4 - DNA, 2000 bp, Wheat
  Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 5 - DNA, 425 bp, Wheat
  Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 6 - DNA, 595 bp, Wheat
  wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 7 - DNA, 1238 bp, Wheat
  misc_feature (1231)..(1231): n is a, c, g, or t
  wheat gamma gliadin Promoter
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 8 - DNA, 2162 bp, Wheat
  wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 9 - DNA, 2147 bp, Wheat
  wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 10 - DNA, 1992 bp, Maize
  maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 11 - DNA, 1358 bp, Maize
  Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 12 - DNA, 1266 bp, Rice
  rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 13 - DNA, 2199 bp, Rice
  rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 14 - DNA, 1024 bp, Rice
  rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 15 - DNA, 2103 bp, Arabidopsis
  arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 16 - DNA, 901 bp, Rice
  rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 17 - DNA, 844 bp, Rice
  rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 18 - DNA, 602 bp, Barley
  barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 19 - DNA, 1729 bp, Barley
  Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 20 - DNA, 879 bp, Rice
  rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 21 - DNA, 666 bp, Cauliflower mosaic virus
  CaMV 35S (pQXNc) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 22 - DNA, 781 bp, Brachypodium
  PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 23 - DNA, 877 bp, Cauliflower mosaic virus
  CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 24 - DNA, 2322 bp, Arabidopsis
  Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 25 - DNA, 2318 bp, Arabidopsis
  Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 26 - DNA, 1321 bp, Brachypodium
  RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 27 - DNA, 1599 bp, Arabidopsis
  Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 28 - DNA, 1774 bp, Arabidopsis
  Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 29 - DNA, 1127 bp, Canola
  Brassica napus NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 30 - DNA, 916 bp, Arabidopsis
  Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 31 - DNA, 3965 bp, Arabidopsis
  Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 32 - DNA, 4074 bp, Arabidopsis
  Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 33 - DNA, 1700 bp, Arabidopsis
  Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 34 - DNA, 1096 bp, Arabidopsis
  RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 35 - DNA, 2432 bp, Arabidopsis
  arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 36 - DNA, 277 bp, Agrobacterium tumefaciens
  NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 37 - DNA, 538 bp, Cauliflower mosaic virus
  35S pEBbVNi Promoter
catggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggact

SEQ ID NO: 38 - DNA, 555 bp, Streptomyces hygroscopicus
  Streptomyces hygroscopicus (A10) Bar Gene
atgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatga

SEQ ID NO: 39 - DNA, 562 bp, Artificial Sequence
  BAR_GA
agcagccatgagcccagagaggcgcccagccgatatcagaagggctacagaggccgatatgccggccgtgtgcaccatcgtgaaccactacatcgagacatccaccgtgaacttcaggaccgagccgcaagagccacaagagtggaccgatgatctcgtgaggctccgcgagagatacccatggctcgtggctgaagtggatggcgaggttgccggcattgcttatgctggcccatggaaggctaggaacgcctacgattggaccgccgagtccacagtgtacgtgtccccaaggcatcagagaaccggcctcggctctaccctctacacccatctgctcaagtcccttgaggcccaaggcttcaagtctgtggtggctgttatcggcctcccgaacgatccatccgtgaggatgcatgaggctctcggctatgccccaaggggaatgctcagagctgctggcttcaagcacggcaactggcacgatgtgggcttttggcagctcgacttcagcctcccagttccgccaagaccagtgctcccagtgaccgagatctgatga

SEQ ID NO: 40 - protein, 72 aa, Arabidopsis
  RUBISCO small subunit protein
MASSMLSSAAVVTSPAQATMVAPFTGLKSSAAFPVTRKTNKDITSIASNGGRVSCMKVWPPIGKKKFETLSY

SEQ ID NO: 41 - DNA, 216 bp, Arabidopsis
  RUBISCO small subunit nucleotide
atggcttcctctatgctctcctccgccgctgtggttacatccccggctcaggccaccatggtcgctccattcaccggcttgaagtcatccgctgcattcccggtcacccgcaagaccaacaaggacatcacttccatcgcaagcaacgggggaagagttagctgcatgaaggtgtggccaccaattggaaagaagaagtttgagactctatcttac

SEQ ID NO: 42 - DNA, 554 bp, Soybean
  TVSP Terminator
ctcaacaatctagctagagtttgctcctatctatatgtaataaggtatgctgatatgcactattcaaataggagcattagctatgtttgttaatgtcactttatgttatgtgggtaagtcacctaagacactccacgtacctacttgttgtctcttacgcggctttaataaatcttctgcccttgttccatatttactaattatccctttcttcactaaaagaaaattgttatcattaagtattagtctttagaacatatgaggtctttaattgggtaggttttacaaattaactaatataaaatgtcataaaatccacgtggttaaacaaatgcagaaaatcgacgtcgtctattggaccgacagttgctattaatataatgggccaccatagtagactgacaaataaattacctgacaacatcgtttcacaaaaaaacaaacacaaaaagggagtgcattttccagggcatttttgtaataaaaaacagttaaaagggagtgcaatagaaatataggggtgtggaaatagtgatttgagcacgtcttgaagc

SEQ ID NO: 43 - DNA, 20 bp, Zea mays
  5prime gRNA
agatgcattgatctcgcgcg

SEQ ID NO: 44 - DNA, 20 bp, Zea mays
  3prime gRNA
atttgccaaagtattccggg

SEQ ID NO: 45 - DNA, 1000 bp, Zea mays
  Upstream flanking region
taacacaagtgtcgaataggaaattcacgagctgtcaaaaaccacatgaggtttgtttttgacccgcgaccgcgagcttgctaacgcaaggtttcagttctcgccgaaacgaaacaaaatgacggtgccgcgcttgcgctgtcatttttttgttttcgacggccaggctgaaactgtatggctgaggatgtcactgagcttcttgtttcctagtgaaaatggtagagagcagttacttgttcacgtgagagaagaaactaaagagaaaataaattagcctttctgcctttgtgactgttttgaacttttgatatatatatccagccttccgcatgctatatttgaatctcaataaacggtgctaggggggttttagcaaaagtacttcaatgttcaatactgtcttaatagacgtccttctctaacatcaaggagtacattgcgtacgggccctatttatttcggtttttggctgttagaatcggcttttggcagccaaatattttgtttttcagattgcttacatgagaatcgcgtctgtaaaaatcgtctaaatcaacgttaatataaaatcctaaattgtgcagagccctccacctttcttaacacacaacacaggtctcaggatattcaaatccatataagagctagattattcagtagtccagattccgaccaaaactctttaggatgctatcacaaacaaacatgtccatattctttcgtgattttaacgtatcgttttcgtgccctctaaccaaaacactcccaaacttgttttcgcttttcgaaaggaggctcgaaattatgaaactaaattttaggaataaagacacaattgcgacacaaaaataacctttttttacccaacttcacaccaccatatgtaggtcttcgtgctaccggatttgccaacacctataaaatttatgtcaggttgtcacggctttactattatcgcgtctaacttcaaacacatctggagatgcattgatctcgc

SEQ ID NO: 46 - DNA, 1000 bp, Zea mays
  Downstream flanking region
ggaatactttggcaaattctgctctgtccttgcaaccaagcataacatacaagtgaccgaaatagacaagcaaagtatatcagaacattgtcaaattgcaagttgcaacaaaactgaagcaaacacaatgtagaaaccattcggagcatcacaggggttggtagcaatctgagatacatgattaaaggaatggtttaatagtacatgcacaattaaatgtttctttttgtttccaagctaggctatgaattgtccacgatcaagctaaaaccccctacccactaaacaggagactgctaggcaggggcgaacagggagcattcctgcatgtaagcaaccagccaaccaaatcacagccatctatcatttcctcttcttagtaggtggttgggggacatcatcgtcatcatcctcttcctcttcttcctcctcatcttcctcattgtcaccatccccatcatcatcgtcgtcatcatcctcctcttcatcctctccaccatcatcatcgtcgtcacttcctccttcaccgttggctgcaggatcgttatcatcgtcgtcgtcatcttcctcctcattcccattgtcatctgatccctcatcaccaccatcatcttcttggttttcagcatcctcatcgtctccctcctcatcattatcatcatcagactctccatcatccttgttctcgaaatcagttgcatttttgtttttgctcagaatccttgtggagaaggaaacaaacaatcctcagctttgggagacgaaaaaaaatgcccatggcaataatgatgtggtacatgttttgacattatgcaccagtgggcattacctattaatcaaattctgatctccaccagatgtaaagatttcattatgaagaatctgcacaagaaagtcaaaacagtacacagtattagctaagacgaggtatatttccaattaaaagtgcacgaacaatgcaacaatggttattcccgggctttaaaggacataagacacg

SEQ ID NO: 47 - DNA, 17 bp, Zea mays
  5prime gRNA after cut
agatgcattgatctcgc

SEQ ID NO: 48 - DNA, 17 bp, Zea mays
  3prime gRNA after cut
ggaatactttggcaaat

SEQ ID NO: 49 - DNA, 4308 bp, Artificial Sequence
  Complete repair construct
taacacaagtgtcgaataggaaattcacgagctgtcaaaaaccacatgaggtttgtttttgacccgcgaccgcgagcttgctaacgcaaggtttcagttctcgccgaaacgaaacaaaatgacggtgccgcgcttgcgctgtcatttttttgttttcgacggccaggctgaaactgtatggctgaggatgtcactgagcttcttgtttcctagtgaaaatggtagagagcagttacttgttcacgtgagagaagaaactaaagagaaaataaattagcctttctgcctttgtgactgttttgaacttttgatatatatatccagccttccgcatgctatatttgaatctcaataaacggtgctaggggggttttagcaaaagtacttcaatgttcaatactgtcttaatagacgtccttctctaacatcaaggagtacattgcgtacgggccctatttatttcggtttttggctgttagaatcggcttttggcagccaaatattttgtttttcagattgcttacatgagaatcgcgtctgtaaaaatcgtctaaatcaacgttaatataaaatcctaaattgtgcagagccctccacctttcttaacacacaacacaggtctcaggatattcaaatccatataagagctagattattcagtagtccagattccgaccaaaactctttaggatgctatcacaaacaaacatgtccatattctttcgtgattttaacgtatcgttttcgtgccctctaaccaaaacactcccaaacttgttttcgcttttcgaaaggaggctcgaaattatgaaactaaattttaggaataaagacacaattgcgacacaaaaataacctttttttacccaacttcacaccaccatatgtaggtcttcgtgctaccggatttgccaacacctataaaatttatgtcaggttgtcacggctttactattatcgcgtctaacttcaaacacatctggagatgcattgatctcgcgcgcttgaaaatttagttattaggttggtaaaagactaggttaggtaagaaatttgaaaacaaaaatccatgggagatgtttttacgtagaagaatagtgagaatttgagaaactttatttcctaagaaacaaagaaagttttggtgaaataattgaaacgaaaaattcgagaaactagaagcccgataatgcccttctcctctaccaactaccagcgcagtcactcgcctctgcacacgtcgctgatgctcgtcttccttccttcccatcctttataaggcccggccgcggctctgctcgcctctcctcccttccctcccgtaccgtatcagtctcccggattctctccggttcgtgggagggccaaagcttcgagttaggaaaaccctaccgctgtgggagtagcctccggcgatggaggtttccaggtggaccccggcggccggcctcctgctcctgttgctcctcccgctcgcggccaccccgtcacgcgccgccacgatggcgagatcgccgtcgtcgtccactgccgtgttccagctccagggagacgtataccccaccggccactactatgtcacgatgaacattgggaacccagcgaagccctacttcctggacgtggacactggcagcgatctcacctggctgcagtgcgacgcaccctgtcggagttgcaacaaggtgccacatcccttgtatcgaccaacggcaaaccgccttgtaccgtgtgcaaacgcactctgcactgcacttcacagcggacagggctctaataacaagtgcccttcaccaaaacaatgcgactatcagataaagtacaccgacagtgcatcttctcagggtgtgctgatcaacgacagcttctcactgcccatgagatcctccaacattcgtcctggcctcacatttggctgtggatatgaccagcaagtggggaaaaatggcgctgtgcaggcagcgattgacggcatgcttgggctcgggaggggatcagttagccttgtttcacagctcaagcagcaagggatcaccaaaaatgtcgtcggccattgcctaagcacgaatggaggggggttcctcttctttggggatgatgttgtgccttcatcacgtgtaacttgggtgccgatggctcagaggacatctgggaactactactcacctggctcaggaacactgtacttcgatagacgttcactaggcgtgaagccaatggaggtggtatttgacagtggtagcacctatacttattttactgctcaaccataccaagctgttgtttctgcgctcaaaggtggtctcagcaaatcacttaaacaggtgtcagatcccactctgcctctgtgctggaaagggcagaaagcattcaaatctgtgtttgacgtcaagaatgaattcaagtcaatgtttctgagctttgccagtgccaagaatgccgccatggagatcccacctgaaaactacctcattgtcacaaaaaatggaaatgtgtgcctgggcattcttgatggaacggctgccaagctgagtttcaacgtaattggagacatcacgatgcaggatcagatggtgatctatgacaacgagaaatcgcagctgggatgggcgcgtggggcatgcactaggagcgccaagtctattctgtcttcctttccctgagccagcgagagacgcaggataaaggccgtagttttgcaaggcgagtagagcagtatgtcagtaatacagcatctatggcatgtgcttttgctcgtccagttcatgagccccgttgtgtatttggtttccgttttcttggttggagtttttagttccaaggtccgatcatgttttgatcccataaattctcttccagccttcgagcaactgagtccatcttcctaagtcatcagccccagcgagacattgaagcatggggaaacttaaacagtatggtgatgattaatctcagcattttttttcttgcagcaatcaatatggactttgcttaaaatttcgttgtcttttcaaaacgatatgcaagcaaaatggaagtgatgttctttgaaactttgtttcaatgctatagcaaaggtttgcattttacaaagttcggtttagtgacgaccatttagatgacatagattatgcttttcgtattttggtagcttctcgtgcggacgcgcggtcatgcctagcatgccgaagaccttgtcatatagtgaaaggaattgcggtagcaattagttcatttttccctaatcccctccaatcactttctcaccaaacaaactccaaaggtcgtcaccgaagggggacgttcccggaatactttggcaaattctgctctgtccttgcaaccaagcataacatacaagtgaccgaaatagacaagcaaagtatatcagaacattgtcaaattgcaagttgcaacaaaactgaagcaaacacaatgtagaaaccattcggagcatcacaggggttggtagcaatctgagatacatgattaaaggaatggtttaatagtacatgcacaattaaatgtttctttttgtttccaagctaggctatgaattgtccacgatcaagctaaaaccccctacccactaaacaggagactgctaggcaggggcgaacagggagcattcctgcatgtaagcaaccagccaaccaaatcacagccatctatcatttcctcttcttagtaggtggttgggggacatcatcgtcatcatcctcttcctcttcttcctcctcatcttcctcattgtcaccatccccatcatcatcgtcgtcatcatcctcctcttcatcctctccaccatcatcatcgtcgtcacttcctccttcaccgttggctgcaggatcgttatcatcgtcgtcgtcatcttcctcctcattcccattgtcatctgatccctcatcaccaccatcatcttcttggttttcagcatcctcatcgtctccctcctcatcattatcatcatcagactctccatcatccttgttctcgaaatcagttgcatttttgtttttgctcagaatccttgtggagaaggaaacaaacaatcctcagctttgggagacgaaaaaaaatgcccatggcaataatgatgtggtacatgttttgacattatgcaccagtgggcattacctattaatcaaattctgatctccaccagatgtaaagatttcattatgaagaatctgcacaagaaagtcaaaacagtacacagtattagctaagacgaggtatatttccaattaaaagtgcacgaacaatgcaacaatggttattcccgggctttaaaggacataagacacg

SEQ ID NO: 50 - DNA, 1248 bp, Zea mays
  Cloned gene CDS
atggaggtttccaggtggaccccggcggccggcctcctgctcctgttgctcctcccgctcgcggccaccccgtcacgcgccgccacgatggcgagatcgccgtcgtcgtccactgccgtgttccagctccagggagacgtataccccaccggccactactatgtcacgatgaacattgggaacccagcgaagccctacttcctggacgtggacactggcagcgatctcacctggctgcagtgcgacgcaccctgtcggagttgcaacaaggtgccacatcccttgtatcgaccaacggcaaaccgccttgtaccgtgtgcaaacgcactctgcactgcacttcacagcggacagggctctaataacaagtgcccttcaccaaaacaatgcgactatcagataaagtacaccgacagtgcatcttctcagggtgtgctgatcaacgacagcttctcactgcccatgagatcctccaacattcgtcctggcctcacatttggctgtggatatgaccagcaagtggggaaaaatggcgctgtgcaggcagcgattgacggcatgcttgggctcgggaggggatcagttagccttgtttcacagctcaagcagcaagggatcaccaaaaatgtcgtcggccattgcctaagcacgaatggaggggggttcctcttctttggggatgatgttgtgccttcatcacgtgtaacttgggtgccgatggctcagaggacatctgggaactactactcacctggctcaggaacactgtacttcgatagacgttcactaggcgtgaagccaatggaggtggtatttgacagtggtagcacctatacttattttactgctcaaccataccaagctgttgtttctgcgctcaaaggtggtctcagcaaatcacttaaacaggtgtcagatcccactctgcctctgtgctggaaagggcagaaagcattcaaatctgtgtttgacgtcaagaatgaattcaagtcaatgtttctgagctttgccagtgccaagaatgccgccatggagatcccacctgaaaactacctcattgtcacaaaaaatggaaatgtgtgcctgggcattcttgatggaacggctgccaagctgagtttcaacgtaattggagacatcacgatgcaggatcagatggtgatctatgacaacgagaaatcgcagctgggatgggcgcgtggggcatgcactaggagcgccaagtctattctgtcttcctttccctga

SEQ ID NO: 51 - DNA, 20 bp, Zea mays
  KO gRNA
gagccaccgggagtaggcgc

SEQ ID NO: 52 - DNA, 17 bp, Zea mays
  KO gRNA after cut
gagccaccgggagtagg

SEQ ID NO: 53 - DNA, 1425 bp, Zea mays
  KO Cloned gene CDS
atggagaagaaggcagctactacagaggaaccccttctcgcgccgcggtccgagcacacggtcgcggcggaggccaagcggctgctgagcctggcggggccgctggtggccagctgcatcctgcagaacgtggtccagctggtttccgtgatgttcgtgggccacctcggcgagctgcccctcgccggcgcgtccctggccagctcgctcgccaacgtcaccggcttcagcctcctcgtgggcatggcgagcgcgctggacacgctgtgcgggcaggccttcggagcgaggcagtacggcctgctcggcctctacaagcagcgggccatgctggtgctggcgctcgcctgcgtcccgatcgccgcggtctgggccaacgccgggcggatcctcatcctcctcggccaggaccgcgacatcgccgcggaggccggcgcctactcccggtggctcatactgtccctggtcccctacgtcccgctcgcgtgccacgtccggttcctgcagacgcagagcatcgtcgtgccggtgatggccagctccggcgccaccgcgctgggccacgtgctggtgtgctgggcgctggtgttcaaggccggcatggggagcaaaggcgccgcgctgagcggtgccatctcctactccgtcaacctggccatgctggctctctacgtcaggctctccagcgcgtgcaagaggacgtggaccggattctccacggaggccttccgagaccttctccggttcaccgagctcgccgtcccgtcggcgatgatggtctgcttggagtggtggtcctttgaactgcttgtgcttctctctggtctgctgcccaatccgaagcttgaaacctcagtactgtcaatatgtctaaacactggcgccttgctgttcatggtgccgtatggtctttgcacagccataagcacacgtgtttcgaatgagcttggtgccggcgagcctcaagcagcgaggctagcagctcgagtggtgatgtgcatcgccctgtctgcaggcttgctgctcggctctaccatgattctcctgcgcagcttctggggctacatgtacagcaacgaacctgaagtcgtcacgtacattgctaggatgatgccggtcctggcgatttcgtttttcacggatgggctccacagttgtctatcaggagtgctgactgggtgcggtcggcagaagattggcgcgcgcgtcaatctcggtgcgtactacttggccggcattcccatggccgtgctgcttgcatttgtgcttcacctgaatggaatgggcctgtggcttggcatcgtttgtggcagcctcaccaagcttgtgctgctcatgtggatcacactgcggataaactgggagaaagaggcaaccaacgcaaaagaaacggtgttcagttcatctcttcccgtagcattatag

SEQ ID NO: 54 - DNA, 1424 bp, Artificial Sequence
  KO anticipated change example
atggagaagaaggcagctactacagaggaaccccttctcgcgccgcggtccgagcacacggtcgcggcggaggccaagcggctgctgagcctggcggggccgctggtggccagctgcatcctgcagaacgtggtccagctggtttccgtgatgttcgtgggccacctcggcgagctgcccctcgccggcgcgtccctggccagctcgctcgccaacgtcaccggcttcagcctcctcgtgggcatggcgagcgcgctggacacgctgtgcgggcaggccttcggagcgaggcagtacggcctgctcggcctctacaagcagcgggccatgctggtgctggcgctcgcctgcgtcccgatcgccgcggtctgggccaacgccgggcggatcctcatcctcctcggccaggaccgcgacatcgccgcggaggccggcgctactcccggtggctcatactgtccctggtcccctacgtcccgctcgcgtgccacgtccggttcctgcagacgcagagcatcgtcgtgccggtgatggccagctccggcgccaccgcgctgggccacgtgctggtgtgctgggcgctggtgttcaaggccggcatggggagcaaaggcgccgcgctgagcggtgccatctcctactccgtcaacctggccatgctggctctctacgtcaggctctccagcgcgtgcaagaggacgtggaccggattctccacggaggccttccgagaccttctccggttcaccgagctcgccgtcccgtcggcgatgatggtctgcttggagtggtggtcctttgaactgcttgtgcttctctctggtctgctgcccaatccgaagcttgaaacctcagtactgtcaatatgtctaaacactggcgccttgctgttcatggtgccgtatggtctttgcacagccataagcacacgtgtttcgaatgagcttggtgccggcgagcctcaagcagcgaggctagcagctcgagtggtgatgtgcatcgccctgtctgcaggcttgctgctcggctctaccatgattctcctgcgcagcttctggggctacatgtacagcaacgaacctgaagtcgtcacgtacattgctaggatgatgccggtcctggcgatttcgtttttcacggatgggctccacagttgtctatcaggagtgctgactgggtgcggtcggcagaagattggcgcgcgcgtcaatctcggtgcgtactacttggccggcattcccatggccgtgctgcttgcatttgtgcttcacctgaatggaatgggcctgtggcttggcatcgtttgtggcagcctcaccaagcttgtgctgctcatgtggatcacactgcggataaactgggagaaagaggcaaccaacgcaaaagaaacggtgttcagttcatctcttcccgtagcattatag

SEQ ID NO: 55 - DNA, 1651 bp, Hordeum vulgare
gttcctctcctcgtcgccggccgggtcctctgctcttgctctgctgctaccgtggccagcacacgtacactgcacctgcacctgcatgacttgtcaaacaaaccaaccaacgacaacccaagctctataaaaacaacccaggccaggcgagttaagcacccattactgctgtgcagttgacgctcactgtgccgtccttgtgagggtgacaagtacttcagctaagctaagctagccaccatggcgagcagcggcagcctggccggtctggcggtgctgctcaccgccgtgctgtgcctgcagctgccggtccacagccgcgcccagctgcgcgtcgggttctacaacaccacctgccccaacgccgaggccatcgtccggcaggccgtcaccgccgccttcgccaccaactccggcgtcgccgccggcctcatccgcctccacttccacgactgcttcgtcgagggctgtgattcatcggtgctcctgtccgtcaaccccggcggaggcacgacggagcgtgacgcggcgccgaacaacccgagcttgcgtggcttcgaggtcgtgaacgccgccagggccgcattggagcagagctgcccgcgcacggtgtcatgcgccgacatcctggccttcgccgcccgggacagcgtgaacatcaccggcagcaacgccttctaccaggtcccctccggccgccgcgacggtaacctctcgaccgacgccggcgcgttcaccctcccggggccgaacctgacggcggccggcctcgtcacagggttcgagatgaggggcctcaacgcggaggacatggtggtcctgtcgggctcccacaccctgggccgctcccactgcagctccttcatcttcaagaaccgcgagaggctggcgagcggcacgatcagcccggcgtaccaggcgctgctggaggcgctgtgcccggccaacacggggcagttcaccaacgtgacgacggagatcgacctgagcacgccggtggtgctggacaacaactactacaagctggtgcagctcaacctgggcctgcacttctccgacgaccagctcatccgcaacgccaccctcaaggccttcgtcgacgccttcgccgccaacgagacgctgtggaaggacaagttcatcgccgccatgatcaagatgggcaacatcgcgcccaagaccggcacgcagggccagatccgcctcaactgcagcctcgtcaacccgtcctcctcctcttcgtccgcttcttacgctggggcgatcgagatgctccgccgcccgggctcgcacgacaaggtcgccatggcctgatgtgtgcgtgcttgaatgccaatgcacgggcgtgctggctagtcggtgtccgttcgcgcctatacttatgaataataaacgttgccgtgctccaagtttgctgaaatgccctttccgatggtccatcttgtacaagtgttaaagttgttaattgagcaaaaataataatgtggcatgttaattaagaagagatatattattatggtgatctaggaaaaaaacaatgctaagcattcgtgtacctaggtgaaaacagaaatctgagtttatacctagctaaatgaagtgagtttggcgaccaaaatataagagtaattataatagtgagcttatagac

SEQ ID NO: 56 - DNA, 1227 bp, Hordeum vulgare
tataagaatctcgcacgcacccaccaacgagcgcatgcatgcaaacaaatcactagcgagccgcatacatcacatcacaaacgaagcgcggcacgcaatggcgccctcctcgtcgtctccactgccggcgtctccgctgctcgtgctgctgatggtgccgctcctgctcgccatggcgcgtccgtgctccggcgtggacgccatcggcacctactgcgctaagaacggcaccagcgcggagacgcaggccagcatcgaccaggtcctcgcggcgctcgtcccgcgcgcctcggcggcgtactacgccacggccaccgccggccgctcctcgtccgcggtctggggcctcgcgcagtgccgcggcgacgtcccgcgtcaggactgctcgctctgcctcgccgcggcggccaaggaggtcgcgtcgtcctgccgaggcagctcggacgggcgcgtcttctacgactactgcctcctccgctactccaccgccaacttcatcggcctcgctgacacggggtacacgctcatcctcctcaacacccagaacgccaccggcgtcgacctggccgcgttcgaccgggcgcaggggaagctcatgtcccgcgtcgcctccgaggccggcgacgccgccaacaagggcctggcgacggacacgacgcgactcggcagcgatggtggcggagccaagacgaccatctacgggctcgggtggtgcaccagggacatcacggcggccgactgcgggctgtgcgtggcgcaggctgtggccgagctgcccaactactgccggtaccggcgcgggtgccgcgtgatctacagcagctgcatggcgcgctacgaggtgtaccccttcttcttcccgctcgacggcgccgacaagtcggccgacgaggtcggacagtgcgacaagattgtcttgaacgcgtgatgtatttgtttgtggagtacaaactacgtgtagtcaactacggtgctatctacgagggcactccagctcgttgtgcgtacctggtcctggtggtggtggcgaatccatttgttagtgtatggctagctcgtagctagccttgaatccaagccttgtgtttgtttgtgtacatgtttgctcgtgaaaatataatttcgcgcaaaccgccatcgtgtaattttcatatttgcaaagccactacctacctagagtaattacttatttgaaagtagttgaatgcaactttgacttgtcggcca

SEQ ID NO: 57 - DNA, 1820 bp, Hordeum vulgare
ccaagaacagaaccgaaacatggagaccacggtcaccgcggtgtcaggcaccacgagctcgagcgtcggccatggagccggcggcggtgctgcgagagtcctcctcctcccgagcccgggagcgcagggccacaccaacccgatgctccagttgggccgccgcctggcgtaccacggcctccgccccacactcgtcgccacccgctacgtgctctccaccaccccggcccccggtgcgcccttcgacgtggccgcgatctccgacggcttcgacgccggtggcatggccttgtgccccgacccggcggagtacttctcccggctggaggccgtgggctccgagacgctgcgggagctcctcctgtcggaggcgcgcgcggggcggcccgtgcgcgtgctggtgtacgacgctcacctggcgtgggcacggcgggtggcacaggcatccggcgtcgcggccgcggccttcttctcccagccgtgctcggtggacgtcgtctacggggagctgtgggcggggcggctggcgctgccggccacggacgggcgcgcgctgctcgcaagaggagtgctgggcgtggagctggggctggaggacatgccgccgttcgcagcggtgccggagtcgcagccggcgttcctccaggtgtcagttgggcagttcgaggggctggactacgccgacgacgtgctcgtcaactcattccgtgacatcgagccaaaggaggtagagtacatggaattaacatggagagcgaagatggttggaccaaccttgccatcatactacctcggcgatggtcgcctaccatctaataaatcatatggtttcgacttgttcaacagcgatgtggagtgtatggattggctagagaagcaaatgaattcatctgttgtgctcgtgtcctatgggactgtctccaattatgatgcaacccagctagaggagcttggcaatggtttgtgcaattctagcaaaccttttctttgggttgtaagatccaatgaggaacacaagttatccgaagaactcaaagaaaaatgtgggaaaattggattaatagtctcatggtgcccccagcttgaggttcttgcacatagggctataggttgcttcgttacccactgtggatggaactcaacactagaggcacttgttaatggtgtcccttttgtgggtattccacattgggcagaccaacccaccattgcaaagtatgtggagagtgcatggggtatgggtgtgcgtgcacggaaaaacaagaatggatgtctaaagaaggaggaggttgagaggtgcattagagaggtgatggatggggagagaaaggatgagtacaaaaaaaatgccatgaactggatgcaaaaggccaaggaggcaatgcaagaaggaggaagttcagacaagcatgtagctgaattcgctaccaagtattcgtcaatataaaacttgaataatgtcttacttaaatataagcaggttgttagtgatttcggctttacaaaagttacaagtgggtgacattttgcatacgttattgtagtgatatcttctccacatttagatgttcgttgctgtcatgtggggccagccctataggcgcaagggccttgcgcgggccggccctgtacctgcctaaaaatatgtcctagtttaattatagtctttttagattaggagtgtgggtattagttggaaaggtttagttcctaagaaggttatcctgccaacacccagttatggtagtagtctgtaatctgatcttgtaattaggctatatatagcgagcccttgggatcaataaagatcaagcagagaa

SEQ ID NO: 58 - DNA, 1272 bp, Hordeum vulgare
agaggcgcccggcagccagaaaagtgcactggagttgtttgtcggaggcaggctagcgagcgaaggaaggagcgaggaagctagctgcggtggtttgttgtgcatggaaggggcggggagcggctgcaagatgggaggaggagaggggatgtccggccgtgccggtgctggtgccgccgcggcggccaaggagaagtccggcttcgccgccacctgcagcctcctgagccgctacatgaaggagaagaagggcggcgctctgcagggcctcgttggcctcgacatggcgccgccggccgccgtcgtcgtaggaggaggagctttccagccgcccaccaccatgaacctgttgtcggggctggaggagccgaacacagcgggcgtggagctcgcactcgagaaatctagtgttggacagcttctcaaggccccaactgacaaccaagatgcgagagaggatgcgcaccagctcaccatcttctatggaggaaaagtggtcgtggttgacaacttcccatccaccaaggtcaacggattgctccagatggccaacggcgccggcgacgccggagacaaggccgggagcagcagcctcgttcagcagagccctccccagcctgcacacaacactctccctgatctgcctatagcgaggaggaactcactccacaggtttctcgagaaaaggaagggcaggatagtggcgaaggcgccttaccaaattagcagctcatcggcggctccgtccaagcaagctaatggtgacaacgcctggctggggctaggccaggaagtgacaaattgacagtgcaagaaagagacatgatgaacacttgacttggctccaaatctatagggcaattgatctacggggagcgtggatgttactactagtattggtagtttactcgtagctttgaagcgacaataatcgggtgttggttattcatttctagtaacaattactatagtagatactacgtatttaagcatatgccgtctgttcgcaccattgtttgctgctggagctgttatgctcacggcagtttggcaggctataggtctactaggactactgtcatggtcattttattgcgagtttgcaacatattacagatggtttgccttcctcaacatgtcactgaaagttgtaattgtcactgattcatgctgcactcttttccctgcttacgttggctgctcagtttttgaggatttgtgtgtatagcagaagatattatttcagatttcataaaaatatgttgtttgaga

SEQ ID NO: 59 - DNA, 774 bp, Hordeum vulgare
accaaaacaacaagaacctacccgtttgttcgacgagcagcagcaagtaatcctgttttggtgccagacaacctgatcgaagcaccaagcatccgttagaggatccatggccatggagaggttcttcacggggctcgttttctgcgaggccccgcttgacggctacggcacgtccgtgctcaccgccggcgtggtcaagacgctggtgctctctggaggcactgcgacgaagccggcagcggtggctagtagggcggacgccgacaaggaccagggatcttccaacggcaagcggacggcgcaaaggagcgctgggttcgagatcgcgttcgatgggctcaactgcttcgacaccgtcgtcatgcactgagcagcatcccttcggtttcttgattttgatctgtatagttatttgatctgtattgacgtggaaaagcttgatccggtctttgaccgtggccaaaacaagtcctacgactattcaacggacatgaaatatttcattcacgtatttcctaggaaagcaacccactctactattttagaactccagcctaccactgtacgtacttttcttttcttcctgcggaaagaagacctgaattcagtggataagatcgccacatcgttatcgatttggcagtagtacagaccacacacagtatgcagcctgttatcctcacggtgcctaaatttcgtgcttttgaactttttctttggaagttgaaccagatctgatcctaatttgtagaaaaaaaaattaaatttccttca

SEQ ID NO: 60 - DNA, 1283 bp, Hordeum vulgare
gtttcaggccttgatccattcctcctccagctccctcaggcttcaggcttcaggcttcgagctgatcacaactctcaagttaccagccatggcggccaaggccacctcatgcttcaccttcctcaaagaagcgctggtcctccccacgcagaaccccaagctcttcgccccaatcttcatcctccttgccgtcatcgccttcctcgtccccgcggtcaacgtggtcttcatccagccgctcaccgccgagatgctccgccacctcgccgagatgcagacaaccgacccctcgaccgccgagttcgccaggctcttgcaggagatacggcaggaaacgagggagctcgtcatcatcaccgtcgccctcacggtcgtcaccctggtgctcgtcttcgccaagcagatcctctccttctccgcggcctgcacgacctactccggcgaccgctacaccctcgcggagctcctccgcaggctgaccaagtggggaaacctgaggggccctctcgtgaccgtgggcgtggtcaccgcgctccagctcacgttcatggtgctcctcggcgtctacctctccagcgtcatgcgccactcggggttgctctccgtgcaaggcgcgctcttcgtcctcgccttcctggccttcatctacttcggggtcgtggccgtggtgggcgtcgccgtgtcggtggccgacgaggggtgccgcggcgtgcgcgcgctcgggcgggcgtggcggctcatgacgcgggtgagcaggaaggagggcgccttgctggcggcggtgatggtcctcctgccgaccgttttgagcccggtgagcgcgctcgcgctcgcgtacgcgaagaagagcatggcggtggggctctgcctgctcgccgtgcaggctctgctgtccggtgcggtggagctgttctacatcgcggcggccacggtgtactactacaaggccatggagagcaagggcgtgatggtcctggcttttgatggctatgccaagataccttcccgtgaggcaaatgtctgattgatcggccggcccctgtatagtgagtcatatatatacttgtggtgcttcctacctgtgtgatcattatcattgtactacatactattttactatgtcaaatcttggaatatgtatacatacatgagataagagtaaaaatatatgtgtgtaggtcagcaaattagtatcccctcctttttatcatcaattgctcatatccaggtcatgaactttagattagtcagtcaaggcagtgaacagagccagaatcttgcaa

SEQ ID NO: 61 - DNA, 1774 bp, Hordeum vulgare
tccagcctttcttcttgcacccaattatctgaccttggagggaagcaatgaatcctgaatcggcaatgagtgaactgccatggagttacctcgccttcggcctcttgggcctggtgcttctgtggccagccacccgactactagaccagctgtggtggcggccgaggcggctggagcgtgctcttcgtgccaagggccttcgtgggacgtcgtaccggttcctcactggcgacatgagcgactacggcaggcaaaacaaggaggcatggtccaagcccctgccgctgcgctgtcacgacatcggcgcccatgtcatgcctttcatctacaacaacgtccaggagcacggcaagcagttcatctcctggttcggtccggttccgaaggtgagcatcaccgatcctagcctggtcagggaggtgatgtccaacaagttcgggcacatccagaagatcaagttcccggcgctctccaagctcctcgccgtcggcgtggccaaccacgagggcgagaaatgggtcaagcacagaaggatactcaaccctgcgttccacgtcgagaagctcaagatcatgctgcccgccttttcttcgtgctgtgaagagcttgttaacaaatggacgcagtcccttggtcccgacggatcgtgggaggtggatgtttccttggagctccagagcctcaccggagatgtcatctcacgcaccgcattcggcagcagttatctggaaggaagaaggatttttcagctgcagtctgagcaggttgggcgattcatggcagccattcacaagatcatgattcctggttacatgtccttccctactgaaaataatcgaaggatgcgtcaaattaacaacgagatagagtccattctacgaggtctgatcgggaaaaggatgcaagctatgcaagaaggaggaagcacaaacgatgacttactcggcttattgctggagtcaaacaagacggacgtaaatgaaaatggccaatccattccaggaatgtccgtagaagaggtgatagaggagtgcaagctgttctactttgcaggaatggagacaacatcaatattgctcacatggacgatggtcgtacttagcatgcatccggagtggcaggaccgtgcaagggaggaggttcttggcctatttggagaacataagcttgactacgagggtcttaatcgacttaaaaccgtgacaatgattctttatgaagttctccggttgtacccaccggctagtgcgttcacccgacagacatataaggagattgagatcggaggcgtcacgtacccacccggagtgatttttgagatgtccgtgttgcacatccaccacgacaaggacatctggggagacgatgtgcaccgattcaggcccgataggttcgcaaatgggatctccaaggcatccaaggaaccgggagcatttttcccgttcggatgggggccacgattatgtatcggtcagaattttgcattgctcgaggccaagatggcattgtgcatgattcttcggcgatttgagtttgagctcgcggcgtcgtatacccatgccccacataccgtaatgatgttgcgtcccatgcatggtgctcaaattaagctgcgggcaatctcttcgtagtagcagcgccatgtacacactcttcactactatgtatactatacacactcttatcttggccatgtaataagagaaggttttcgttgccttgtgtatttggtaataaaggtccaacattattcagggccatgataattcaatcc

SEQ ID NO: 62 - DNA, 1343 bp, Hordeum vulgare
aatttcaaactccaaacgcagccgatcaccaccagcatttccctcctcccctcactccgtaccccgcgattgtccgtcctcgcgctctcccgaccgcggtagccatgggcaccctcgtcggccacgtcgcgccgggcgccggcttcctcctcataggcctgtggcagctgttcaaccacatccggctgttctcgctgcggcccggctcctacgccgcgccggtctggttccccgcgcgcggcgtccgccacctcgagctcatcctcgtcatcgtcggcacgtcgatgtccatcctgatggagctcgtgatcggccccgcgaagcaccagccgttcgacgacgacgggaccatcccgtccgaccacctccacaacttcgagcacgcgtccatctcgctcgccctgctcgcgttcgccgcggtcaccatccacatggacagggtccgggcgccgatgcgggacgccgtgtcgcagctggccgccgccgcggcgttcgcgcagcagctgctcatcttccacctccactccgcggaccacatgggcgtggaggggcagttccactggctgctgcaggccgtcatcgccgtcacgctggtcaccacggtgctgggcatcccgtacccgcggagcttcgtggtgagcctggtcaggtcggcgagcctcgtgttccagggcgtgtggttcatcgtcatgggcgtcatgctctggacgccggggctcatccccaaggggtgcttcctcaaccgcgaggacggccacgacgtggtccggtgccgcaccgacgaggcgctccaccgcgccaagtcgctggtcaacctgcagttcagctggtacctgacgggcaccctggtgttcgtcgtcgcgttctacctgcaggtcagcaggctgtatcccgaagagccgcagtacttgccgctggtcaaggggggacgcgccggcggccggttcagcatcggggacgacgacgatcacgaggacgatgacgacgaggatgatgacatggaggccgcgaagcgtggctacgggcacgtggtcagcggcacaaaacccatggaggtagagaggtagtagtaaaactggagccgtataccgtatgaaaggaaggaacggtcaagatgcatggtcgtatttatatacatacaacggtcaagatgtatgtgttgtagattgtatagttctttcactttggtggatttggtttcaccgagtgaactgacccgtaaatgcgggtgaagttcgtgtttggtcactttaaatttgttggagatttgtttgtttatttaggctggattgttgttcctgatcgtcggagtacaatggattcattggctggcttgtggatgg

SEQ ID NO: 63 - DNA, 2087 bp, Zea mays
actcggacggacgagcgaggcagccccgcaggtcgcagccacaacccaagcgcagcgctctgcctgcctccgctccggctcagctcccgccctgcctccgccttccattccaccgcgcggcgctgccgagtgccgacgtcgtccccgccggagtttctggtttctgggttggatctctcggagtcggagcgagcgaggatgggcggcggcaacggtgaaaccacccagctgggggagccactgctggcgaagaaggcgaaggcgtaccgccctaggtgccccggctgccgggtggaccgcctcaacgcggagcgggagggggtcttccctctcaaggacctcttcctcatctggctcgtcaccatcacctgcaccctgccgatccagtctctgttccccttcttgtatttcatgataagggatctgcatattgctaaacaaacacaagacattggattttatgctggttttgttggcgcttcatatatgtgtgggagggcagtctcctcaacagtatggggaatcgtggctgataagtatggaaggaaaccagttatcgtactgacccttattgcaatagttatcttcaatactatgtttggactaagctcaaactattggatggcattaatcacacgatgcctgcttggaatcatgtgtggttatctcgggccaattaaggcttatgctacagaagtgtgccgaaaagaatacaatcatctggctttggcagttgtttcttcctcacgaggcattggtctcattattggtccagctattggtggttatcttgcgcagcctgcagataaatatccaagtatattctctcagacgtccatatttgggaggtttccatactttcttccgtgcctgtgtatatcaatccttgcagttattgctctaattgcctgcatctggtttccggaaactttgcataaacacaatggggatgccgttgataattcagttgaaaccgtagaagaatctcttgctggcaccgacactgaagaaaatggaggtggcggatgtctaaaattatttacaaactggccgttgatgtcagctattactttatattgtatcttctctcttcaggatgtggcttatgcagagacattctctctttgggctgtcagtgacagatcgtttggtggattaagctttactaccacagatgtgggcaatgtccttgcgatgtcaggtctcttcctttttctatatcaaatgttgatctatccgttccttgccaaaacggtggaccacatcacattagtccgtgcagtggcgttattgactctaccggttcttgctagctacccattctttccttcgttgtccgggttcgggctcatggtggtagtaaattgtgcatcttttctgaagaatacattctcggtaactaccattaccgtgttcaacattttgatgaatgaagctgtgactcaggatgtaagagccgcagccaatgggatagctgtaacactaatgtccatctctaaagcggttgctccagctgttgcaggaatcatattttcgtgggcccagaggcgtcaaacagctgcatttcttccaggcgaccacttggtgttcttcatactgaacatcttcacgttcatcggtttcgtcttcaccttcagaccgtttttcgttcgaggcagtgccaagcactgaaacatggatgaaccggacgacgacccatggtatcctatccaggggcaatcgaatataaattttcttccggcgtggccaagggaggtgccgagtctgtaccagtacgacgactcaggccagaacacacggcgtatggtatggtacacagcaaggccgtgttgttgctgtaagttttgtaatttctgtttccttctcggcttcgcagcatgcagttgctgtatatgatggaagaacactctgttactgggcatgttgcgcggtttccacgcgtgtaagtaatgtagaagtcgctatggtaggtatttccataccgtcattagtggatcattgatttttttttgtaagaaggttattgcaatgccctttttccgggcatgaataagaaaaaggaaatatgcttatatgcatggtatgaa

SEQ ID NO: 64 - DNA, 589 bp, Zea mays
caaacaggcaaacacacaacacaaccaaccacctcactcgatctctcatcactcgcaagtccagctatcaccaaccagacagagctcggctgcaagcctccaacccaaggagacagatacgttcgcagatggcgggtgcagcgaaggcgtcgtggatggtggccatgagcgtgggcgccgtggaggcgctcaaggaccaggggggcctctgccgctggaactacgcgctgcggtccgtccaccgcaccgccaaggccaacgtccgcagcagcctcgccgcgcagcgggacaaggagctggccccggcggcggagtcgaagaggcggccgggcaaggccgccgcggaggaggggatgaggaccgtcatgtacctcagctgctggggacccaactaggaggactagctagggttcactgttcagttcattgctggtgctgggttcagttcagacctggctggccggttgcctcctgcgattgtaaaataggaatacggtcacgacgatgaatgatgatgacgatgaaaagttctgccactgtatgtttcaggcctgtgggctcaaaacaagaattcggtggtgcttgatgg

SEQ ID NO: 65 - DNA, 788 bp, Zea mays
gcgcgaagccaagtctgggcaccagccggcagccgccaggatacttgatggacgactgtggcaaacctttcgtgaagagagagctcagactctccctaaatcctgctccttgcggcgacgacaaccccactactcccaccggagccgcctccgatggcggctcgtcagcctgcacctcggccgtcgcgctgttcgttctcgggctcaacagcgcaatagccatctacggctcgagacacgacccccagtccatactgtttgtggccgtcagcttcttctgcgtcgtgcttctcttccacctgctccgtgcgttcgagagaacgcccccgggatcgccccggaggttgcaggtgaaggcggccatatgggtcgtcaccaccgccctgacggtcatgttctccggcagagttgctccgttgatgcctgcgcccgtggccgccgtcgtctggtccatggccgcggtgacgatccttgcgggcttctacatgttcttcgtatgcccggacgccgccgaagagaggccgaccagcaaagttgttgccgaaggcccgtagatagtttgtgtgtgcgcgcgattccgccatcgaagtatcgtgatgtaaacaactctaaatttaaggtgagcgtccgtgcgtaacaacgggaacatataataatataataacttatatataaaatatatcttttataacaaaatatgtcttatattgttataagaaaatgttttataatctatttgtaatcctagccatacataaattttattatttaatttagctgtttcacta

SEQ ID NO: 66 - DNA, 1520 bp, Zea mays
caaacggcaggctgcacctgcaacacaagaaaagaaaaggcgcgccttttctcctctcgttccaccgacggcgacgcaggcctcacccgcaccaaccttcgttctccttccccttctcctccacgcgcgtcaatttgccatcccaggaaggcagaaccccacacctctgatctgctctgcccatcatccagcgcatccccggccctgacttaacttgctgctcacctcgccatgggaatctcccaccctctctccgacgagtacgacgccctccgcggcgccgtcctctcgccggatacgacgcctccctcatcgccgctcgcccaccgccacctcctggagcacgaggttactaggatggacacgctcgccggcatcgccatcaagtacggcgtcgagatatctgacatcaaaagggcaaacagtttggtaactgacagccagatgtttgcacacaaatcgctgctcatacctctaccaggaatgcccatgccatccctgaatgcttgtggtcaaagaacgataagaacgtgtgctccaaaccatcggcaaaagagagacgcgcccaagtctcgtcagcagggtgcgtcatctgcaatgaataccttgcagagatactatggcctaacaccacctcagaaaggaggaaataccatggatagcagcactgaactgtctgtgtaccataagggcggcggcttccagagtaacctcagcgaaacattgctcaatccttccgcagctccaggcaccgacagcagctggaattttgaagcgctaggcttttcagcgaccgagggcgatggcggggcaccgaaaccagagcaagatggttctatgcggcggcgacagaaagtggaagcagagtctaacgcccagggtgattttctagtgaaggcgatcaagagtctgttgatttccagcgtccgtctagacacgtatgcaggcagcccaggttccagccagaagagcggcttcagatctgtgactgtgaggaagtccccgagcgcgcccagctttgcggatgctgacaatggagtctctatgtggtcaagttccaagtggacgttcagccatgactccttcacccgaccgttgcttgatggcctgcccaaaccagcgtcagctcggaggaccaaccaaaaccgcgttggactgaaactgaactgaatacacacatgtttgagcgtctcctttgatgaacgacgagctgtggcgtgactaggcgactgacttggcagcagagcatatctgtctgcagctctggtgttagcacaattgattggcttgtacaactcctacaaaagagaagagttacgatggagcctagctacatgtaatgtatacaacatgcatacatgcatgtgttgatggaatgaattgtattgtatcccatcccaggcagtgctacacacagatattctgtctgctgtgtgatggggtgaatttggtttcagttactccctaaatcaaatggaagttcttcttttttttttcccactgtggtttggttttcgtta

SEQ ID NO: 67 - DNA, 2170 bp, Zea mays
tactgttttatattgtagatacgacaatagatgagaagacaatcactactatttactactaagacatcgcagtcgcagacccgatctgcttatatatactcccatccgttccattcctgcttgttcttccaatcccccctcccccggcgtgcgctccctcctgtctctcttggcgacgactgggcaacggtcgcagctgtatgttcgagcccttcgccgacgacgttcaccaccaggaattttctcagctgtgccaatgatgggttgcttcactgttctcagatccaagaagaagaaaagccattttgataatcctcttgtcccaagcaagaaatcagttgatgcaagggaaagtacgtcctctagacttccggagccagaagttcatgtgccatctttgcaatcagctcctcctagttttaggaacagggtcaagatatccgagtcatcaaatgaagtttcaaacagaaacagcagggctcgcgtgctgtctgctccatcagcccttattgtggttgatcagtttggctttccatattcggaataccgagatcaagatgactccagggataaggaaggtttgacaaaggggcatcgcttttcaaatcctttgccccttcctcttccttcacgcgaaggacattcttttaggaactctggtagcttcaaagccagcaacgtaagcgggccattggagatgtctggccctctcccattgcctctaaagaaatgtgatggacttagaatcttctcttatgaggagatttcatctgcctgccaacgattttctagtgatcagtgtgtttcagaaacacttggttcaacatcatacaaggcaacatttagagatgaatttattgatacgaggaccactgaagcaacagtagctcgattactcccctccactcagagtttgaaggagtttaaaacgcaagcgaccacattggcatcgcttcagcatcccaatttatgtaaactgattggctattatgcaaaagaagattctaatgaaaggatgttggtctatgaacggctttatcatggaagcttagataagctactctttggaagatcagatggtcgtttcatggactggtctaaacgtttgaaggttgccctgggtgctgccagaggtctagctttcttgcatgatgaaggaccctttcaggccatgtacagcgagttctcaactttgaacatccaaatagataaaggtttcactgctaagctttcaggatatggttgtgttggcttcaataccgaggagatatctaatgcacctgtgtctgcagcaaacctttcggtggagaccttggagaagggtttactcactcccaagagcaacgtctggagctttggagtcgtgttactggagctaataactggaaggaagaaccttgatcccaattattccaaagaagaacgcaatattgtcaactggagtaggcctttccttactgatgacagtcgcttgtctcttatcatggactcccgtataaaagggcgctttcccactaaggctgctcggatagtagcagacatcattttgaaatgcctgcgtaaggatccatcggagaggcctaccatgagggatgttgtggaggccctagcaagagtccaggaaataaaggttccgtgcagatatcctctgcaagaaccttctgctgcaccaagaaaagtgatgttgaaatctacatccctcaatgggattgtgcctcaccatcctgtcataaccttctctccatcgccgccttcacataaccagcacttgatttcaccaaggtcgtcgacatctgccttgtttcatccaagggcatgctcttctaccctggacgatccgagtgtaagttctataaagaaaacaccacctattatgcgaaggtctagcgtcgaaggcttttgattgtccatattgttcctttatttccttttcttggatttatttgtttctttgttagtagtgtagcggtttttagctgtgttctgtattgtaagacaagtggcctcatatgtagtgcccttgggtctggagtaaagcagaacaggatgaattgtaaataggaccaggttgtagataccttttttttgtgctcgaattgggtggaagcagcgtgccgagtgggccttgtaacctcataatgcaataaactccgtttcccagtttctgttc

SEQ ID NO: 68 - DNA, 1377 bp, Zea mays
gagaagtgtactacgcgagagcttgccggaggctctggatccctgtgataataataaactgatataagcagaggaagcggggaggaagctgcgagttggagggggccgggagaggcgtctctggttattgcttgtccctgcttcccggtgagctgctgggagtggacgggccgggaaggagacgagaagataagggcgccgcgcgcggccatggctggaagtgcgccggcgacggcgatggacaagaccagctttgccaccacgtgcagcctgctgagccagtacgtcaaggagaagaagggcggcctgctgcagggccttggtgccctcgccatggcgccggcagctggagaaggagctttccggccgccgaccaccatgaacttgctgtcagctctcgacgacgcgccggccgaggagcgcagcgagaaggccaccgccggggagccaaaacaccaggacaaatgcaccggcggaaatccaagggaggaggcagccggagaggaggaggaggaggcgcagcagctgaccatcttctacggcggcagagtggtcgtcttcgacatgttcccctccgccaaggtcgaggacctgctgcagatcatgagccctggcggcgacggcgtggacagggcaggcggtgccactgtccctacgcggagcctgcataggccttcacacgacagcctctctgatctgccgattgcgaggaggaattcgctccacaggtttcttgagaagagaaaggacaggataactgcaaaggcgccataccaacaagtcaacagctctgttgttggcgtcgaggcgtccaagcaggcggctggagctggggtggaaaaaccttggctggggctgggccaagaagcgacaacagcgaagctggagatgtgatgaatgttgcccgacaagaaggtgcagtgcacgagattcacggatggtgcaggtcgtagcttcaggttaaggtgaaggataacttaccgtcgggtactctactcactttactgctctactactactactgctggtgacgaagttagcaagaaacgttcttctgctaccggtgggtcggtcggtcagccgttcgttggcgagattgtttgctgctggagacggacgtgctcgcagcagtttcgctggtccgtgaccgcgccatatgttgccacgaatggttggttgttcggtacgttgaggaacgatgtgtatgtagtgtgcacgtttccggtgcatcttgttctcctcaagcctgtcctgtatgtttacccccctgcaccccctcctccctctttgtagagagagggtctgtatgttcagtggaagatggttgttctatttgatttttattttatggacatgtatgctcggtgatgtgttgtg

SEQ ID NO: 69 - DNA, 1260 bp, Zea mays
acgaggcccccgcgttcacgagccagaagagaagagaggctaaccaccgcagcggctgcgacctgcgagtgcgacaacctccgcggaggagttggagccggcggcggggatatttgcttgcccggctggggttgcggcggaaggagggagagacaatcggcgatggcggcgtccgcgaggcccggggagagggcgaccagcttcgccgtcgcgtgcagcctcctcagccgcttcgtccgccagaacggcgtcgcggctgccgacctaggcctcaggatcaaaggcgaggtcgagcagcagaggacgccggcgacaactaactcgctccccggagcggagggcgaggaggtcgaaaggaggaaggagaccatggagctgttcccgcagagcgtcgggttcagcatcaaggatgctgctgcccctagggaggagcaaggagataaagagaagcctaagcagctcacaatcttctatggcgggaaggtgctggtatttgacgatttccccgccgacaaggcaaaggatctgatgcagctggccagcaagggcagcccagtggtacagaacgttgttttgcctcaaccctctgcagctgctgctgtcactactgacaaggccgtgctggacccggtcatcagcttggccgctgctaagaagcctgctcgcacaaatgcttctgatatgcctattatgaggaaggcttctcttcaccgcttccttgagaagagaaaggatcgcctcaatgcaaagacaccatatcaaactgctccttcagatgccgcaccagtcaagaaggagcctgagagccagccatggctcggattaggaccgaatgccgtggattccagcctgaacctcagctagtacacaacaacacagccataataagacggcacagcaacggcacccaccatgacctggaatttgctttgccactagatcgagttcagaaaccataaatattcttagttatcgtgttttagtgttcgcttatgtcgtggttctacgccctcttgtcgcatagttctggatgtaaagaaaagtagccagtcatgaccatcaccgggagtcggggagaagtttttggagggtgttaacacacggcgactctgaattggccatgctaaggaaaaggatagtgcaatgtgaggtatatgtattttctgaaagccagatcgtttgggtctagccctgatgtatgcagaacaagtgattattgtaatggatcctgattatcctcatcatcctattgttgttttc

SEQ ID NO: 70 - DNA, 1198 bp, Zea mays
attcctcttccgacacacacacataacaacgagcagcacagctcacgctcggctacgactacgatccgcgcgcatcgatggcgatgagtgacaccggctcgagcttcgcgcagtgggccgcgctctaccaccaccacgaccccgccggcggcccggtcctgcccgacgacgacgcggcggacgctggcaacggcatcggcagcggcaccgccaccgccgcgagcccgacgtcgggagggtccagcggcgggagccccaccaccaaggcagcgtgggggcagcagcatctgcttcacggggtggaggggccccgggtcgccgggaagccggcggcggcgcggcggcggtcccgcgcgtcgcggcgggcgcccgtgacgctgctcaacacggacgccgccaacttccgcgccatggtgcagcagttcacgggcgtccccgcgcccctcgccggcgcgttcagggtcggggacggggccccggtcatcagcttcgccgccgactacggcttcccgcccgcttcttcttcctcggccgtcaacgtgtccttcttcgaccaccagctccaccggagccaacaacaccctgcagcgccgccggtccacaggcagcagcagcagtacgccggcgcgtcgccgttcggcggctacagcagcggcctggtgcaaggcggcggcgcaagcgacgtcttccccgcgtcggcggaggacaggatgctcctgcagagcattctggccgcccagatgccgcacatgccgccggtgtccggcgctaacaccagctctcatggcttctttgcttgaataagtaagtagctgaccaaggtactacgacggcgtcatccatgccagtatgccacatgcatggaagctagagaacatgggggagatggagtgaggattagcagcctagcagtagcaaagaagaagaagaagaaggggtaatcacaagtttccctggttgcgtttgattagttttcttatccgcgcgcgcagcttcatttgtttctccgctagctgcagcgatgtaaatatctttatcttgtttttaaaagatgcagtagtctctgtacacgtactagctcatccgagatttgcatagctttcgatcgtattcggtggcggcgaacattatctcgttttgattgcgcccggttgcccggttgcggaagcaaaggtcgtggcggcggccgcccgcccag

SEQ ID NO: 71 - DNA, 1998 bp, Zea mays
tcatgactctctattagaatagccaggggcctcgctcctctccaccacgtactccactccatccatccatcatcgtctatccatgaagagcttgcaggaggagagggcggcgttggtgccgtcgccgtggccccagcaacagagaaaggacggcggcgagcatgatccggagcagctgatggatgaggatgacggtgacgatgaggaggatctgcaggatgagcagcacacaagaacaattaggacgtcgaccaagacggcggaagcatcgtcatcagcggagcggcgggtgccggcgtggtggaggctgcggcgggcgcagaagctgctggtgcccaccagaggtgttggcctggtcatcgccggtctcctcgtgctggtcttgctcctcgtcgtcggcggcggcggcggcgccaacaccagtcgtcgtcgctggatccacctcgactatgcatcgtcgtttctgcgcggcggcggcttgaggcagcatcaatggcctcctcaccacgtcccttcacccgcagccgacctcgtgcccatacccttcagctgcggcggcaacggctcggcatgtccccgtcgtcaaaccgcaacatcacccccctctccgtcgccatcatcgtcatcgccaccagcaggcaccaagtcatcatcgtccaagaataaacaaccccctcctcagtgcccggattacttccgcttcatccactccgacctgtcgccgtggcgcgagacggggatcacgcgcgaggcggtggagcgggggcgccaccgggcggcgttccggctggtggtcgtggacggccgcgcgtacgtggagacgtaccaccgcgtgttccagacgcgtgacaccttcacgcagtggggcatcgcgcagctgctggcgcgctaccccggacgcgtcccggacctggacctcatgttcaactgcgaggacatgcccgaggtcaaggtcaagccgtcggaggagtcgtccgcgccgccgctgttccgctactgcaaggacgactccacggtggacatcgtgttcccggactggtccttctggggctggcccgaggtcaacatccgtccctgggcgccgctgctggaggagatggccgccgagatgggtcgcctgccgtgggcggaccgggagccgtacgcgtactggaagggcaaccccaccgtgtccgccgagcgcgccgacctccgccgctgcaacgactcctcgtcgtccggcggcacgcgcgtgttctggcaggactggggcgccgccatccgggacggcttccgggactccaacctggccaagcagtgccgctaccgctacaagatctacgtgcgtggccggtcctggtcggtcagcctcaagtacatcctcgcctgcgactcgccggtgctgctcatcgccacgcccttcaaggacttcttctcccggggcctcgtcgccggcaggcactactggcccatcgaccccggagcccgcaagtgcgccgacatcaacttcgccgtccacgactggggcaacgcgcacccggagcaggcgcgccggatggcggaggaaggcagcggcttcgcgcgccaccagctcagcatggactacgtctacgactacatgctgcacctgctcacccagtacgccggcctgctccgctacaagcccaccgtgccggagaacgccgtagagctgtgcgccgagaccgtcgcctgccccgctgcgcaccacagcaacaggagggagttcgacttcatgatgcagtccagggagaggtacatcgccgactaccagccctgcacgctgccgccgccctttaccgaccgtcacatcagggagatgacgcgaagagaccaggaggtgcgcgccaacgtgcacaagatgatgaccaccgtcactccatgacgtcaccaattaagggattctcttgttctctatctatctatcttgaatatccacttcgttatactacgtcctggtctctgtctctataatattaaaatatcagttttcatggtctt

SEQ ID NO: 72 - DNA, 1412 bp, Zea mays
gccttcatcagttcgttctgcgcgggaaccgccgatgggggacgccgtggaggacatcgtcatcgccggcgcgggcctcgccggcctcgcgacggcgctcgggctacacaggaaaggggtgaggtgcctggtgctggagtcgtcgccggcgctgcgcgcgtcggggttcgcgttcaccacgtggaccaacgccttccgcgccctggatgccctcggcgtcggggacaagatccgggagcaccatttgctctacgagcggatgatcgccttctctgcagctactggtgaagcagctgcagaagtgagcctaaagattcagagcaaaagcgggccacacgagatccggtgcgtgaagcgggacttcctgctgcggacgctggccgacgagctgccggagggcaccatcaggtactcggccaaggttgtcgccatggaggaagacggcgtcggcggcgccaagaccctgcagctgcacctggcagacggttccaccataaaggccaaggtcgtgatcgggtgcgacggcgtgaactccgtggtggcccagtggctgggcctgccgaagccgatcctgtcggggcgctcggccaccaggggcctcgccgagtacccgggcggccacggcttcggccccgagatcctgcagttcatcggccacggcttccgctccggcgtgctgccctgctccgacacctccgtctactggaactacacctggtacccgtcccccgcggacggcgacgccgaggagagcgtggccaagatgcggagccacgtggtcgccaagctgcggggcgccaaggtcccggccgaggcgctggaggtggtggagcggagcgagatgagcgacgtggcgtcgtcgccgctgcggttccggtccccgctggcgctggtccgcggcagcatcagccgcggcggcgtgtgcgtggcgggcgacgcgctgcaccccatgacgccggagctcgggcagggcgggtgcgcggcgctcgaggacggcgtcgtcctggcccggtgcctgggcaaggccttcgccctgctcggccaggagcgggatgaggggcgggtcgtcacggcggcgctggaggagtacgcggcggcgaggcggtggcgcagcatccagctcatcaccgccgcctacgtcgtcggcttcatccagcagagcaacaacgccgtggtcaggttcgtcagggacaggttcctgtctcggctgctgtccaaaacgctggtcgccatggcggactacgactgtggggcgctatgatctgccgccccttgcagtgctgtgagagatatatacaccacacacttctttataaaaaatcacgcaaaatatatctgtggtgtcgtgtaaaggggtgatctgagaccgagtgaaaggtgttttttatcacgcccaattaatccgctgcttg

SEQ ID NO: 73 - DNA, 1534 bp, Zea mays
gcacgagaggaaggtggggaaggaaaccacagccgcttctggcgggcgctcaccctgccccttccacctcgcctcgcctcgcaatggaggtttccaggtggaccccggcggccggcctcctgctcctgttgctcctcccgctcgcggccaccccgtcacgcgccgccacgatggcgagatcgccgtcgtcgtccactgccgtgttccagctccagggagacgtataccccaccggccactactatgtcacgatgaacattgggaacccagcgaagccctacttcctggacgtggacactggcagcgatctcacctggctgcagtgcgacgcaccctgtcggagttgcaacaaggtgccacatcccttgtatcgaccaacggcaaaccgccttgtaccgtgtgcaaacgcactctgcactgcacttcacagcggacagggctctaataacaagtgcccttcaccaaaacaatgcgactatcagataaagtacaccgacagtgcatcttctcagggtgtgctgatcaacgacagcttctcactgcccatgagatcctccaacattcgtcctggcctcacatttggctgtggatatgaccagcaagtggggaaaaatggcgctgtgcaggcagcgattgacggcatgcttgggctcgggaggggatcagttagccttgtttcacagctcaagcagcaagggatcaccaaaaatgtcgtcggccattgcctaagcacgaatggaggggggttcctcttctttggggatgatgttgtgccttcatcacgtgtaacttgggtgccgatggctcagaggacatctgggaactactactcacctggctcaggaacactgtacttcgatagacgttcactaggcgtgaagccaatggaggtggtatttgacagtggtagcacctatacttattttactgctcaaccataccaagctgttgtttctgcgctcaaaggtggtctcagcaaatcacttaaacaggtgtcagatcccactctgcctctgtgctggaaagggcagaaagcattcaaatctgtgtttgacgtcaagaatgaattcaagtcaatgtttctgagctttgccagtgccaagaatgccgccatggagatcccacctgaaaactacctcattgtcacaaaaaatggaaatgtgtgcctgggcattcttgatggaacggctgccaagctgagtttcaacgtaattggagacatcacgatgcaggatcagatggtgatctatgacaacgagaaatcgcagctgggatgggcgcgtggggcatgcactaggagcgccaagtctattctgtcttcctttccctgagctcagttctatgtacttctgatagagtttaagaaaatcactatatcaaacctcctcgcaatgcatgaatttcctaactgaagagggagggagagagagagagagaatgttcctgtttatgtagagatggagtccaaaatttgtgtgcctgatgagttcttccccatatgatattaactgaaatagtatatcaattgaatgta

SEQ ID NO: 74 - DNA, 4696 bp, Zea mays
gcagcagagggaaggaggagggacggcgagatggacgcggcgggggacattcagaaggtggcgagtatgcggcggggcgacagcggctccatttggcggcgcggtgacgacgtgttctcgcgctcctccagggaggaggacgacgaggaggcgcttcgctgggccgcgctagagaagctgcccacctacgaccgcgtccgccgcgccatggtcccgctcggcctcggcgccgacggcgccgaggcggcgggcaggaaggggctcgtcgacgtggacgtgctcagcctcggcccacgcgagaggcgggcgctgctggagcgcctcgtccgcgtcgccgacgaggacaacgagcggttcctgctcaagctcaaggaccgcgtcgacagggtcgggatcgacatgcccacgatcgaggtacggttccagaaccttgaggcggaggcggaggtgcgcgtcggcagcagcggcctccccaccgtcctcaactccgtcgtcaacacgatcgaggaagcggcgaacgccctgcacatactgcccagtaggaagcggatcatgcccattcttcacgacgtcagcggaatcatcaagcctcgcaggatgacacttctgttaggtccgcctggatcaggcaagaccactttgttgctcgccttggccggaaggcttgacaaagacctcaaggtttcaggcaaagtgacctataatggtcatgagatgacagagtttgttccagagaggacggccgcttacatcagccagcatgacctccacataggagagatgactgtgagggagacgcttgcattctctgcacgctgccagggtgtcggctcccgttttgatatgctgactgagttgtcgaggcgagagaaggcggctaatatcaagcctgatgctgatattgatgcattcatgaaggcgtctgcaatgggtgggcaagatgccaatgtggtcactgactatattctgaagatattaggactagagatatgtgcagacacaatggtaggggatgagatgctcaggggcatatctggtggacaacggaagcgcgttacaactggtgagatgctggttgggccagccagggcgcttttcatggacgagatctcaactgggcttgatagctccactacattccaaattgtgaactcgctgaggcagtccattcacatcctcggtggcacagctgttatctccctactgcagccagcacctgagacatataacttgtttgatgatatcatactcctctcagatggtcaggttgtgtaccagggtcccagagaagaagtgcttgagttttttgagtctgtaggtttcagatgccctgagaggaagggcgttgctgacttcctgcaagaagtgacctcgaaaaaagatcagaaacagtactgggcgcgacctaatgagccctacaggtttgtggctgtgaaggaatttgcgactgcattcaagtcatcccacacagggagatctataacaaatgagcttgctgttccgttcgacaagagcaaaagccacccagccgcactaaccaccacaaggtatggtgtgagtggcaaggagctgctcaaagcaaacatagaccgggagatccttctcatgaagaggaactcttttgtctacatgttcagaaccttccagctgatgctcatgtcaatcattgcaatgactctcttcttccgtaccaagatgaagcatggcacggtgaatgacgggggtctctacatgggcgcactcttctttggtgtgcttatgatcatgttcaatggcttctctgagctggcactaactgtcttcaagctgcctgtattcttcaagcagagggatctccttttctttccagcatggtcctatactataccctcatggatcctcaaggtacccatcacatttatcgaggttggtggttatgtattcttgacatactatgtcattgggttcgacccaaatgtcggcaggttcttcaagcagtatctgcttctgttagtagtcaatcagatggcagcatcactcttccggtttattggtggggtatcgaggaacatgattgttgctaatgtcttcgcatcgttcatgttgctagttgtcatggtgttgggaggatttattctagtaagagataaagtgaagaaatggtggatctggggctactggatctccccaatgatgtatgcacaaaatgccatttcagtgaatgagatgttgggccacagctgggacaaaatattgaatagcactgcatccaacgagaccctaggtgtgcaagtccttaagtcgcgtggagtattcaccgaagcaaagtggtactggattggctttggtgctatggttggtttcaccatactcttcaacgctctcttcactgttgcccttacatatcttaagccatatggcaactcccggccatctgtatccgaagaggagctgaaggagaagcatgcaaacatcaaaggggaggttctggatggcaatcacttggtatcagcaagcagtcatcgatcaacaggagttaaccctgaaactgattcagcaatcatggaagatgattctgccttgactaaaaggggaatgatcctcccatttgtcccgctctcgctcacctttgacaacatcaaatactctgttgacatgccacaggaaatgaaagctcaaggtgtacaagaagatcgtttggagctcctcaaaggtgtcagtggatcttttaggccgggtgtgttgaccgcactgatgggcgttagcggtgcaggaaaaactactttgatggatgtgttggctgggagaaagacaggtggatacattgaaggagacatccgtatttcaggatacccaaagaaacaagacacctttgcacgtgtatcaggatactgtgaacaaaatgatatccactcgccacaggtgacagtctatgagtccctgcttttctcagcatggctccggcttcccaaggacgtcgattcaaacaaaagaaagatcttcattgaggaggtgatggagcttgtggagctgaaaccactgagaaatgctttggttggacttcctggagtgaatggtctgtcaactgagcagaggaaaaggcttaccattgctgtggaacttgttgcaaatccatctatcatctttatggatgagccaacctcagggcttgatgcccgagcagctgcaattgtgatgcggacggtgaggaacactgtcgatactggtagaactgtggtctgcacgatacatcagcctagcattgacatatttgaagcatttgatgagcttttcctcatgaagcgtggtggagaagagatctatgctggtccacttggacatcattcttcagatctaatcaagtattttgagtcacttcatggggtcagcaaaattaaagatggctacaatccagcaacatggatgctggaagtgaccacaacttctcaggaacagattctaggtgttgatttcagtgacatatacaagaaatctgaactctaccagaggaacaaggccttgataaaggaattgagccaaccagcaccaggttcaactgacctgcatttccctagcaagtatgcgcagtcttccattacacaatgcgtggcttgcctatggaagcagaacctgtcatactggaggaaccctccttacaataccgttaggttctttttcactaccatcattgctctcctccttggcaccatcttttgggacctcggcggcaaaacgtatacatcacaagacttgatgaatgccatgggatcaatgtactctgcggtgctgttcattggagtcatgaattgtacctcagttcagccagtggtggccgtggagcgaacagtcttttaccgtgaaagagctgctggcatgtactcagctttcccatacgcgtttggccaggttgtcattgagcttccatacgcactggctcaggatatcctttacggtgtcatagtgtactctatgatagggttcgagtggacggctgctaagttcttctggtacctcttctttgggtacttcacgctgctctacttcacattctacggcatgatggccgtggggctgacacctaactaccacatcgccgcgatcgtctcctcggcattctacgccatctggaacctcttctccgggttcatcatcccccgaccgaaagtgccgatctggtggaggtggtactgctggatatgccccgtggcgtggacgctgtacgggctggtggtgtcacagttcggtgacgtcatgactccgatggacgacggaagggccgtgaaggtgttcgtcgaggactacttcgacttcaagcacagctggcttgggtgggtggccgccgtggtggtggcgttcgccgtgctctttgcgaccctgtttggctttgccatcatgaagcttaacttccagaagagataatgacgataggagttgggaaatcacctcctaggagacaaagggatttttgcattcgttgggtcgtgcaagtagatttgactgtgcatattgggagagtacgccataatatatggattcgttgattagttaaagttatagaagttattgtgtgctcctgttttttttttttgataggatattgtgctcctgtttttttttgataggatatattgtgctccttttctaggagggtgatgccgtagtactttgtaaagaatatttcacacatccagtaaaattccttgtcgccccttgcaaa

SEQ ID NO: 75 - DNA, 1774 bp, Zea mays
cctctgccccttgggctgcctcggctcgctcatctgccgcgcccgagctgacgccaacgcgaggagcaaaaatcctagcaaccgctcaggtttcttccccttcagtagccgtagcccttgctttcgtcgtccttgcggcagcttggcgagaatttttctcgctgcggttgagtgcgagccattccggtgggtaagacagagttgggggagcgtcggttagttaattcttcgcccatcatcagtcggaggagagacaggaggaggtgcatggccggcatggagggttccaattccagctcgcagccgccgccgttcctcatcaagacctacgagatggtggaggacccggcgaccaaccacgtcgtgtcgtggggccccggcggcgcaagcttcgtggtgtggaacccgccggacttctcacgggacctgctgcccaagtacttcaagcacaacaacttctccagcttcatcaggcagctcaacacatacggtttccgaaagatcgatcccgagagatgggagttcgccaacgacgacttcgttagggggcacacgcacctcctgaagaacatccaccggcgcaagccggtgcacagccactcgccgcagacccaggtgaacggcccactggcggagtcggagaggcgcgagctcgaggacgagatcagcaggctcaagtacgagaagagcctgctcctgacggacctccagaggcagagccagcagcggtgcgggatcagctggcagatgcagtcgctggaacgcaggctggcgcagatggaggagcgccagaggaacatcgtggcctccctgcgcgacatcctgctgccggtcggacacggggtcgtttcgtgggggtcggcgacgggggcggaccacttcagcaagaagaggagggttccgaagatggacttcttcgtcgacgaacccaaggtcgaagaacagcaggtgccgttcctgcagacggtgggcgcggagacgccaggcatgtctccgatccgccttctgagcgccgagccgtttgagaagatggagctggccctggtgtcgctggagagtttcttgcagagggcaacagcgcatacgtctgctgctcaaggcatgttgtacgccgctggtgttgctgaacccagccctgctctggctctaggcgagatgctctcggcaccaatggataccgagatcgatctgcagccatcagcttgccagaaccccttcgcttcgacctcagggcaagaccagtcgtcttctccgttggcagaacccccgagctactacgcccagagcccgatgctgccgatggcacagctccatgaacatgcccataggacagctgctggagtcgatatgaactctgacaccacaaccggcgacacctcgcaagatgataccaccagtgaaactggaggttcccatgtgccggccaaagtgaacgatgtattctgggagcggtttctcacagacgccgccgagggtaaaagcgaggcaatagaagcaaaagaggatgtgaagactgccgtagaccgctgctgtcctcgtctccaggacaatgttgatcagatcactgagcagatggggcagcttgattcagcttcttatgcacccgagaattactgataccacaccatcggtgttgccgctgtacattatagtttaggctagctaagtcttttctagcatttcctactgtaaaaagtaaaatcatatgctgacccatgtacattacgtatgtcctcgtgctgttgagctagagcacagattcagttatttgctg

SEQ ID NO: 76 - DNA, 768 bp, Zea mays
atgcctcggtcggtcgaacaatcttcaataacccagtcggcaggcgtgacccgatgctctcgcgtcgtcggatcgtcgccaccgtctcctccgcgtcgcctacaccgacatggacgaccggcagtatgccggactgaccaaggcaggcttgggcgtgctggccttcaactcgggcctcgccatctacaactcctggggcgacgcgagctccgtcgcgttcgtgctcgccgcggactccatcctcgtgctgctcttcctctgcctccgtgagctggagctgcaggggcggggggccgccggcaggggcagggatgtcgggatcatcagagccgcggtgtggacgctgacgacgctgctctcggccatgttcgcgtctagggtggcgccgctgatgccgcccgtcgtcggcgcgctcgtctgggcgacggctgtggccactgccgccggcggcttctgggcggtcttcctcagctgaatgtttaggcttagttcgacgagagagtgatcctgtgcgtgctactagctagtttgttaccatatttgcacttttgtatgcagaagatattttgtatgttgttttctgcattaagacggtctccagttgatcttttgtatgcagaagatattttgtatgttgttttctgcattaagatggtctccgccggttgatcgtgtaaatgatcacgtaatacgttattgtacaccgtagacaatattgtttacgaaaagaagtttgagttagataataagatagaatgaattgagcac

SEQ ID NO: 77 - DNA, 933 bp, Zea mays
ctccacaagtccagagacccggccagctgctttagtttgattccaattccaaccaacaaccatcagcagacagcagcttattaatttgattcggacatcgatcggttcatgctagctctgcggacggccgcgcgcacgtacgtacgtacgttcaacggatagctagctagctagctagctgagagaccatggacagcaagctgggcgtgcagcacgggcaccgccaccaccacagccacaacggcgtctccaagccgccggtcgcaaggaggaggcagagcggcggcggcggcggcaagggggtcaaggtggtgtacatctccagccccatgaagctcaccgccagcgccgaggagttccgggccatcgtgcaggagctcaccggccgcgactccaacgtcgccgaccacgacctcgacggcggcggcgcctaccacgtgggcgcgccgtcgtcgaccacgaccacgacgacttcctactcctccctcggacgcgtctccccggccgtggcggaggcggcggccgccgcagcggcgggagcccgcgctcggtcgtcgccggcgaccaacgccgggggggcgtcgccggtggtcgagtacgccgccgcgatggcccagccgccgccgttccagttccagggcatgtacgaccaccagattgccgggagcttgctttacggcctggacaactggtaggaacatatcgtatgctggacgggattagtttgtcttcggctgcgatttgattgtttcacatgcgacgcctatgaggaggacacatgtcgaccacgtcgtgtatattatatctgtagcgtgtattcacatactacggtttttgtatgtgcgtgcatggttcttcttctttaggctgcaccatccatcatcttgtacttgatatgaacagtgtgttaatagtggctagatgtatctatca

SEQ ID NO: 78 - DNA, 1472 bp, Zea mays
gacacgtgcttgggccttgggaaacaagcaagctagtagtagaagaaacaaaggcgccattgatgagaagacggaaggctggtttgcatttgccgctgagatctggtaacgcctcgcctcgtcagcatctctataaacgtagaattcagttgctggccccgttgctcctccacctgggcttctctcaccaacacccgcgatgtcatcctcctcgccgccgccgccgcacgtcgtcgaggacatgccccatgtcctccagcttctcagcgacggcacggtggtccgcttcgccgactacgacacgctccctcccccgtccgtgcctcccgcgccgctgcccgtccggtggaaggacgtcgtgtacgacgccacccacggcctcaagctccgcgtgtacagtcccagtccgccggcctcctgcggcaagctgcccgtgctggtctacttccacggcggcgggtacgtcctcggcaccttcgcgctgcccagcttccacgcctgctgcctccgcctggccggcgagctcccggccgtcgtgctttccgccgactaccgcctcgcgccggagcaccgcctccccgcagccctcgacgacgcggcggccgtcatgcgctgggtgcgcgcccaggccgtcgcggcggggggaggggacccctggctcgccgactcggctgacccgggccgggtgttcgtcgccggcgactcagcgggcgggaacatcgtccaccacgtcgccgtccgccgcctcggctcggcggcctcgggcgagctcgacccggtacgcgtcgccgggcacgtcatgctctgcccgttcttcggcggggccgagaggacggcgtccgaggcggagttcccgcccggcccgttcctgacgctgccgtggtacgaccaggcttggcggctggcgctgccgccgggcgccacgagggaccacccgttcgcgaacccgttcgggccggagagccccgcgctgctgggcctgcgcgacgtcgcgctcccgccgacgctcgtcgtggccgcggggcaggacctgctgcgcgaccgccaggcggactacgtcgcgcggctcaaggcgatgggacagcacgtggagcatgtcgagttcgagggtcagcaccacgggttcttcaccgtggagccggccagcgacgccagcagcgagttggtccggctcgtcaagcgcttcgtgtatggcgacggcgacggcaactccatctaaactggactcatgagccatcatgatcatgacctttgttgttagcttagcacgagtactcgcgtgacacgaacagagctgaagttggcctaacctgccacgcgcaccaagctggatgttcgatcagcgacaagccatgttaggtacggcgccaccatcagtccaccagcactgttcgaatctgacatcagttggcttaggcctatgtttcctccagctttttatcagttcagatatgaacagctaggaaagtttt

SEQ ID NO: 79 - DNA, 1711 bp, Zea mays
gtatttaagcgtgccggtgcagctaattggttccagatcttatcccttccagttccaggcagcatccccagcctgacgaaggaattgaggacgctcgagctcgagctacgtcaggatccaacaccaccatggttacgggaaagaagaggacgttcgtgctctacccgtcgctgggcgtgggccacctgatcccgatggtggagctggccaagcacctcttgcgccacggccacggcgcgctcatcgccgtggtcaacccgcccgacaccgacgccgtgtcggccgccgcggtggagcgcctcgcggcggccaacccggccatcgcgttccgcctcctgccggtcccggccagcccggacgccggcgcggactgggtgaagcgcgacctggacacgctccggctcgccaaccccgtgctccgggacttcctgctccggtcccagcccgcagccgacgccgacgcgctcatcctcgacatgttctgcgtcgacgcgctcgacgtcgcggcggagctcggcgtcccggcctacttcttcttcgcctccgcggcgggggacctcgccatgttcctcaacctgccgtacctctaccccaccctgccgtcgttcagggacatgggcgaggcgccggtgcgctgccccggcatgccgccggtccgggcgatggacatgccgctgacggtgcaggacagggacagcgaccggaccaaggtccggatgtaccagttccgccgcatcccggaggggaggggcgtgctggtcaacagcttcgcctggctggagcccagggcactgagagcgctcggcgacggcgtctgcgtgcccggccgcccgacgccgagggtcttctgcgtcgggccactggtcaacgacggcagcagcacggcggggggcggggggaggcacgagtgcctggcgtggctggacgcgcagcctaagcggagcgtcgtgttcctctgcttcggcagcaagggctccttccccgccgcgcagttacaggagatcgcccacgggctggagagctccggccaccggttcctgtgggccgtgaggagcccgccggaagaaccggacacggacctggggaagctgcttcccgaagggttcctggacaggaacagagacagaggcatggtggtgaaggactgggtgccacaggcagaggtggtgcggcacgaggcggtccgcgcgttcgtcacgcactgcggctggaactccacgctcgaggccatcatgtctggcctgcccatgatatgctggccgctgtacgcggagcaggggctcaacaaggtgttcatggtggaggagtggaggatcggggtggagctgcgcgggtacgaaaagttcgtcaaggcggaggagctggaagcgaaggtcagactggtgatggaggctgaggaagggaggatcctccgggagaggctcgcggtggcgagggagaaggcgttgggggctactaaggaaggcgggtcttctgaagtggcattcgcggagttctttggagatttggacaagagcagctctccgtcggtaaacggagaatgcgattgaattgatcactggtgtgctggtgtggcagatggactgcgaacgtatatatactttaggattcaatatcacttagtattttgacagtacgagactaaaatattgcatctgtggtatgggaataaaattggattcaagcagagcgccacttgcgttgcgtgtta

SEQ ID NO: 80 - DNA, 1000 bp, Zea mays
tccatcagtaacttggcgggactgcgggacatcgacgcatcccatatctataggcacaatggagcactacgactcctatctatgcagcggcagcatgcatagctacggcggcgttggcggagccacggacgcggcgttggacgccggcggtgacgacatgcagcgcctgctcaacgcgctcatggacgacatggctgccgagtccgactccttctccgacgacatggaggcagcctcctccgagtcctcgtcctccgcctgctcggccaacagccagcaggaggccacccggcggccacagcagcaaccggacggtggccacagcaacggtagcaacaagagctccaagaagcagcatcagcagcaatcgccggctccctacatcggcgtgcgcaagcgtccctggggcaagttcgcggccgagatccgcgactccacgcgcaagggcgcccgcgtctggctgggcaccttcgacagcccggaggccgccgcgatggcctacgaccaggccgccttctccgtgcgcggcgccgccgccgtgctcaactttcccgtggagcgcgtgcaggagtcgctgcgcgcgctggcgctctcttccgcctcctctgccgcgggctcccctgtcctggcgctcaagtgccgccactccatacgcaagcgctccccgaacaagaacaagaacaagaagcaggagcggcagcaacaggtggccgtggccgccgccggaccacagcagccgccgtgccccaccagcgttgtggagctggaggacctgggcgccgattatctggacgagctcctccgggtgtcatccgagttccattggcaataacccatagcgaatggcggtcctgcgaggtgcaagcgaaagcgaggttgatgggttggggatcgagttcagttgtcatcacaaatacagaatgcctgcagattgttgcagagcactcctgctctgctctgtccttgctcgccaattgcgaatcgacgacgagttgcaact

SEQ ID NO: 81 - DNA, 1533 bp, Zea mays
gcagtcacccacaaccaattagccattggccagcacagcagtgtataggcatagctacgtacgtgggaagtgggaacgatggcactcatcatgcaggagagtagtagccatgatttgctccaagctcacgacgagctcttgcaccattccctgtgcttcgccaaatcgctcgcgctcgccgtggcgctggacctccgcatccccgacgcgatccaccaccacggcgccggcggcgccacccttctccagatcctcgccgagactgcgctccacccaagcaagcttcgcgcccttcgccgcctcatgcgcgtgctcaccgtcacgggcatcttcagcgtcgagcaaccaccagcaggtggtggtgataattcaaccgtccacacgtcggacgacgaagctgtcgtcgtctacaggttgacggcagcctcccgcttcctcgtcagcgacgaggtgagcacggcgaccttggctccctttgtgagtctggcgctccagcctatcgctgcctgtccgcacgccctgggtatctccgcgtggttccggcaggagcagcacgagccgtccccgtatggcctggcgttccggcagaccccaacgatctgggaacatgctgacgacgtaaacgccttgctgaacaaaggcatggccgcggacagccgcttcctcatgccaattgtgctgagggagtgcggcgagacgtttcgtgggatcgactcgttggttgacgtcggtggtggccatggtggcgccgccgccgccatcgccgccgccttcccccacctcaagtgcagcgtgcttgacctcccgcacgttgtcgccggtgctccgtctgatggcaacgtgcacttcgtcgcaggcaatatgtttgagagtattccacctgcaaccgctgttttcctcaagaaaactctacatgactggggtgacgatgagtgtgtcaagatattgaagaattgcaagcaagccatatctccacgggatgcaggtgggaaggtaataatcttggacgtggtagttggatataaacagtcaaacataaagcatcaagagacacaagttatgtttgatttgtatatgatggcggttaacggagttgagcgtgatgagcaagagtggaagaagatcttcattgaagctggattcaaagactacaaaattctacccgtcatcggtgacgtatcagtcatcatcgaggtctatccttgaatgctttgtgaacaaagacctccataataaactgaagaccatgaaggtgttgatagtatattatgaatttttatttgtattgtacacttgattctttgagtatttgtaatgacaagctgagtaattgtgtttttttgttaatgtggtcttatagtgcacattacacatgatgtatgatatgttatttgccctcattttggtgtagatgtgtgttggtcaagtagtcgataggcaactctattatgcttggcatcaataagacaacatggaagcctatgatttgttgtgtcatggcaacaaggaaaattgtggtcttggtgaaaaatg

SEQ ID NO: 82 - DNA, 1374 bp, Zea mays
cacgtcgcctgtccacataccagcacgggctcaaggctctggctcgcgcacccctgtccctccctgttccgcaccgcacacctagactagacgcacctccaactgcagcgcgccatacttgaccgcatcagcatggcatccacggggacgacggcggcggcggtgccggaggtgaccctgcggtcgggcaacggaaagccgatgccgatggtgggcatgggcacggcgtcgttccccgtggtgcacgaggccgtcagggacgccgtgctggcggccatcgaggtggggttccgccacttcgacacggccttcctgtacggcaccgagaagccgctcggcgacgccgtggccgaggcgctgcggcgcggcctcctgcggtcccgggaggagctcttcgtcacgtccaagctgtggtgctcgcagacccacgcggacctcgtgctgccgtccctgcgggaaactctcgagaacctgcagatggagtacgtggacctgtacctgatccactggccggtgtgcctcaggccggccggcgggccgcccaagttcccgaacaggaaggaggacgcggtgccgctggacgtggcgggcgtgtggcgcgccatggaggagtgccagcggctgggcctcgccagggcgatcggcgtcagcaacttcaccaccaggcacctggacaaggtcctggccatcgccgcggtcccgcccgcggtgaaccaggtggagctgaacccggcgtggcagcagcggacgctgcgggcgtactgcgccgaccggggcgtccacgtcgccgcctactcgccgctgggagggcagaactgggacgggcggggcaacgccgtgctcgactcggaggtgctcgcggagatagccagggcgagggggaagaccgtggcacaggtggcgctgcgatggatacatgagcagggagtgacgtgcatcgtcaagagctacaacagggagaggctgaagcagaacctcgagatattcgactgggagctgaccgatgacgaccggctcaagatcagccacatcccgcagaggaaggttgtcgaggccagcggcttgttctcgcaggagggtgagttcacgtccgttgatcccgcggaactgaatattgtggaggaataggaactggactggaaaatggcccccgcctgtcggtgttgctccgtataggaacatacgaataataaggcaacgttcgccctcggtgtttcgggggtgtattccacgatgttttccatccccgttcagttcagtaaagattgtgatcgtataatattgaggacttctttggaacggtcgagctatagtacatggttccgtaaactttgtatgaattttctgatctaaataaagtggggttttacgaac

SEQ ID NO: 83 - DNA, 3337 bp, Zea mays
ggaaagtttcttctgcatcttttctggaaaccagcattgagcgattggtcatagcacgtctctctgcgtcttggatcatccagggatcggttaatccagacaggtacttttctggattctatcgaagacttccgatcgaagcacccacagaaaagaaagcgatcgcgacgacgcatctcgcgaaaccccggtgggaaacccagggatcggcgggcgggcttcttgtgcgtgctcatagtcatggtcagatccgatcccttaccgcgatactccatcgggatcagctttgtccgggcaggcttctcggattgttgctgaagcaaggaaggagggaaagctagcgcaagcgactgccccacacacagcaccgtacgtgttctcttctcctagctagcagcagctttcctctctcgttcatgcatctccatggatatatatatataagacagacagatcctcgccggtaggggtcgtcggctatcgtgtaccttgtgttggcctccgatccacaagaagctagagctagtatcgagaggccaggggcaggctaggcggcgcgcggaagagcatgtggtcgtcggagatgggtcgaagaagccgccgaacgaacggcatggtggcagagccgcagacgacgcagctgctgctgcacggggtgatcgaggccaccatcctggaggccgacctgtccgtcaccacagacggcaagctgcagccgaccaagaagactctgatgaagaagaaggtcttctcatggatcaggaagctgacattctgcagaaaccagctggagaacgccatcggtctcggcacggacggcaagctgtacgcgacggtggacatcgacaaggcgcgcgtggggcggacgcgcatggtgccccccgtccactcccccatgtgggacgagtccttccacctctactgcgcgcacgacgccagcaacatcatcttcaccgtcaaggccgacaacgccatcggcgccacgctcatcggccgcgcttacctgcccacggagggcgtcgtcgccggccggaaggtggacctgtggctccccatccgcgacgagaagcgccagccgctggaaggcggtgaccagatacacgtccaggtccagttcaccgacgtcgccgcggacccgaccgccggctggggcgccgggatcggcagcgcggcgtacggcggcgtgccctacaccttcttcaagcagcgccgcggatgccgggtgcggctgtacgaggacgcgcacgtggccggcgacttcgcgccgcgcgtccggctcgcggacggcagcttctacgagccgcgccggtgctgggtggacgtgttcgacgcaatcaaccgggcccggaggatggtgtacatcgccggatggtccgtgaacaccgacgtggtgctggtgcgcgacccgcgggaaccgtcggcgtcgtccgagagtctcggcgagctgctcatccggaaggccgacgagggcgtcgcggtgctgatgctggtgtgggacgaccgcacctcggtggggctcggccccatcaagcgcgacgggctgatggccacgcacgaccaggacacggcgagcttcttccgcgacacgcgcgtgcagtgcgtgctctgcccgcgcaaccccgacaaggaccggagctacgtgcaggacatcgagacggccaccatgttcacacaccaccaaaagacggtgatcgtcgacggcggcggcgcgccggcgccggagacgccgccgggcctcgtgagcttcctcggcggcatcgacctgtgcgacgggaggtacgacacgcaggaccacccgctgttccgcacgctgggcaccacgcacagcaaggacttccaccagcccaacttccccggcgcgtccatcagcaagggcgggccgagggagccgtggcacgacatccactgccgcgtggaggggcccgcggcgtgggacgtgctggagaacttcgagcagaggtggaagaagcagggcaagggggacaacctcctggtggcgctgaacaaggcgtgggcggagcgcgaggcggccccgcggggcgacgccgagtcgtggaacgtgcaggtgttccggtccatcgacggcggcgcggcggcggggttcccggagggctccgcgaacgcgccccgggaggcggcggcgctcgggctggtgagcggcaaggaccacgtgatcgagcgcagcatccaggacgcgtacatccacgccatccggcgggcgcgggacttcatctacatcgagaaccagtacttcctggggagctcctacgcgtggcggcagaacgacggcgtgacggtggaggacatcaacgcgctgcacctcatccccaaggagctgtcgctcaagatcgtgagcaagatcgaggccggcgagcggttcgtcgtgtacgtggtggtgccgctgtggccggagggcgtgccggagagcggctccgtgcaggccatcctggattggcagcgccgcaccatggagatgatgtataaggacgtgacgctggccatccgcgccagggggctccgggccgaccccagggactacctcaccttcttctgcctcggcaaccgcgaggcgccgagccccggcgagtacgtgccgccggagcacccggaccccaacaccgactacgagagggcgcagcaggccaggcgcttcatgatctacgtccacgccaagaccatgatagtggacgatgagtacatcatcgtgggctcggcgaacatcaaccagcgctccatggacggcggccgcgacacggagatcgcgatgggcgcgtaccagccgggctacctggcgaccaggaaccggccggcgaaggggcaggtccacggcttccgggtctccctgtggcaggagcacctgggcgaggcggcggcggcgggaatgggcgacgatctcttccgtccgtcgagcctggcttgcgtgcgccggatgaaccaggtggccaagcagcactgggacatgttcgcgagcgacgcgttccagggcgacctcccgggccacctcatggcgtacccggtcagcgtgctcgacgacgacgacggccgggtcgtggccacgacggaaaccttcccggacaccaacgccaaggtgctcggcaacaagtccgacatcctcccgcccatcctcaccacatgatttaatcatcgtcgattgtattcaccgccacgccgtgggaatgtgtacacaagcgagagaagcatgcatgtttaaaaagctgaaatgtgattcatatgtcaaacaaaaacagaataatttaaaagcttaaatgtgattcatcatcctttccgaataaacacctcacacgattgttggacatgcatgagagcttcatcgata

SEQ ID NO: 84 - DNA, 1435 bp, Zea mays
attgttatcgcgatgcagggattatattgggtcttgcttattattcgttgacccggttcacaaacacggttccaagcacattgtataaatagagagtaacatctaaagcagctcttcatctcctctcctcgtcaccatctcgatcgagctccagagctaaagcagatagaaagctcagagtgagagagcagcatctgatcgaccaattgttcaccttcgtcatgaggtcgacttggttggcatttgccttgtcggcgctcgtcgtcgtctcctcatcagcggcacacgtacacgcctcgccggggaaacttgaggtcggtttctacgagcactcatgcgcacaggccgaggacatcgtgcgcaacgccgtccgccgcggcatcgcccgtgagcccggcgtcggcgcggggctcatccggatgcacttccacgactgcttcgtccggggctgcgacggctccatcctcatcaactccacgccgggcaacatggccgagaaggactccgtggccaacaaccccagcatgcgcggcttcgacgtcatcgacgacgccaaggccgtcctcgaggcgcactgcccgcgcaccgtctcctgcgccgacatcgtcgcgttcgcggcccgtgacagcacctacctcgccggcggcctggactacaaggtcccgtctggccgccgtgacggccgcgtgtccaaagaggaggaggtgctcgacaacaatgtccccgccccgactgacgaggtcgacgagctcatcgagagcttcaagcgcaaggggctcaacgccgacgacatggtcacgctctccggcgcgcacaccatcggccgctcccactgctcctccttcacgcagcgcctctacaacttcagcgggcagctggggcagacagacccgtccctcgaccccgcctacgccgggcacctaaaggcgcggtgcccttggccgtccagcgacgaccagatggaccccacggtggtgccgcttgacccagtcacgccggcgaccttcgacaaccagtactacaagaacgtgctggcgcacaaggtcctgttcatctctgacaacacactgctcgacaatccctggacggccggaatggtccacttcaacgccgcagtcgagaaggcatggcaggtcaagttcgccaaggccatggttaagatgggcaaggtccaggtgctcaccggcgacgagggagagatcagggagaagtgcttcgctgtcaacccacactactagtcaagtttagccaataagccttgccagggtactaagtttgtttatacgttccatatatacgtcgatattatggagattgttttcttcttcaaggttgtgaaatcaaacacaagtttatcaagtaaaatggtgttatttgcacaacatgcataaatttactgttgttatcctcttacaaatatactagctatttttcc

SEQ ID NO: 85 - DNA, 3666 bp, Zea mays
ccactgcgcaccttcccttcacttcccccacagcgcgcgaggcgcaacttccggctatgtgcttgcccacgcctgaagtcgccgtcacgtccttacgcgtcaacggcacggccccacgcgggtgagagaggagagccccccacgcacccgcgtgaatatatactcgcgcggccacggcagggttggtgggagagcgaattcgagctggtcgaatccggcagccgagcgagatggagagctatctcaaggagaacttcgggggcgtgcaggccaagcactcgtcggacgaggcgctgagacgatggcgcaaggtcgtcggcctcgtcaagaaccccaagcgccgcttccgcttcacggccaacctcgacaagcgcaacgaggccaccgccatgaagcgaaataaccatgagaagctacgtgttgccgtgcttgtttcaaaggctgcacttcagttcattcacagcgttgctccgtcgagtgagtacaaggtccctgccgatgtcaaggcggctggtttcggcatctgcgctgaagagctgagctcgattgtcgaggggcatgatgtgaagaagctgaaatctcatggtggcgtgcagggcctcgcgtccaagctatccacttcggagtctgacggcctcaccacgtccgcggacaagctagcgacccggcgggatgtttttggcgtcaacaagtttgcggaggcggagtcccgtggcttcttggtcttcgtctgggaggcgttgcaggacatgacactcatgatccttgccgcgtgcgcgttcttctcgctcatcgtcggtatcgccacggagggatggcccaagggcgcacacgacggcctcggcattgtggccagcatcctgctggtcgtgttcgtcacggcgtcaagcgactaccgccaatccctgcagttcaaggaccttgacaaggagaagaagaagatcacggttcaggtcacccggagcggctacaggcagaagctctcaatatatgaacttctcgtcggcgacatcgttcacctctccattggtgatcaggtgccggctgacgggctgttcatgtcaggcttctcgcttctgatcaacgagtcgagcttgaccggagagagtgagccagttgccgtcaacgttgagtacccattccttttgtcagggacgaaggtgcaggacggttcttgcaaaatgctcgtcacgacagtcggcatgaggactcagtgggggaagctgatggccactctcagcgaaggtggtgatgacgagacaccattgcaggtcaagctgaatggtgtggccaccatcatcggtaagataggacttatctttgcagtggtcacattcgcagtgctcacccaaagcctgttccggcgcaagatcattgatggtacgtacttgagctggactggagatgacgcattggagctgcttgagttcttcgccattgctgtcaccatcgtcgttgtggcagtacctgaagggctaccgctggccgtgacactgagccttgcatttgcaatgaagaagatgatgaacgacaaggcactcgtccggcaccttgcagcctgcgagaccatgggctcagcgacctccatttgcagtgacaagacaggcactctcacaacgaaccacatgaccgttgtcaaagcctgcatctgtggtaagatcaaagaagtggatggtgtttcggatatcaagaacctgttctctgaactcccagactctgtcatggcgattctctcccagtccatattcaacaacactgggggagacgttgtcttgaaccaggatggcaaacgtgaaatactggggacacctactgagacagcgattctagagttcgggctgtcacttggtggagactttttggcggtgcgcaaagcaagcactcttgtaaaggtggagccgttcaactctgccaagaagagaatgggagtggtaatccagctcccagagggtgcactgcgagcacactgcaaaggtgcatcagagatcatactggcatcttgcagcaagtacctgaatgaagatggcaatgtcatccccctggatgcaggaaccattgatcacttgaaggccacgatcgatagcttcgcgaacgaggcacttcgcactctctgtcttgcctacatagaagttgaggatgggttctcagtcaatgatcagatcccaacggatgggtacacctgcattggcattgtggggatcaaagacccagtgcggcctggagtgaaggaatcagttgctatctgcaggtcggcaggtattacagtcaggatggtcacaggtgacaacatcaacacggcaaaggcaattgcccgggaatgcggcattttaactgaaggtggcattgccatagaaggcccagatttcagaaccaagagtgaagaagagcttactcaactgataccaaagatacaggtgatggcaagatcttcaccactggataagcatacccttgtcaagcatcttcgaactaaactctacgaagttgtggctgtgactggtgacggaacaaacgatgcacctgctcttcatgaggctgatattgggcttgcaatgggcattgctggaaccgaggtggccaaagagagtgctgacgtcatcattcttgatgacaacttctccacaattgtcactgttgcaaaatggggtcgatcagtttacatcaacattcagaagtttgtgcagtttcagctcactgtcaatgtggttgctctggtggtaaacttctcctcagcttgcctgacagggagtgctcctctcactgctgtgcaattgctctgggtcaacatgatcatggatacactgggtgcgctggcattggcgacagaacccccaaacaatgaactgatgaagagaacacctgttggaaggaaaggaaacttcatcagtaacattatgtggagaaacatcctgggacaggccttgtaccagttccttgtaatttggtacctacagacagagggaaagtggctgtttggaatcaagggcgataactccgatctagtcttgaacacactgatcttcaattgcttcgtgttctgccaggtattcaatgaggtgagctcaagggagatggagaggataaatgtatttgaaggcattctaaacaacaacgtgttcattgctgtcctcggcagcaccgtcatcttccagttcatcataatacagttcctcggcgatttcgcaaacactacccctcttacgctcaaccagtggatcgcatgtgtttttatcggtttcataggcatgcctatcgcagctattgtgaagatgatcccagttggatctacgtagtgaattagagctaatttcgtccagaaactgaagttgggcatggctacagtctgatcatggcaatggagttttctgggttgccatttgtgtacaagatagatctgtgctatgcttctattctggtcaatctttgcctcttttatcctgtagtatcttatcagccaaggttgtggactcgattgttagaaaatgccttgggctcttgtagctgttctttgctttatattttttcttggtgcttttgctaggaacattggaggctggagctgtatatgacaatcttgttgttcactcgaatgtgcttgttttgacacctatcattttgcttcatctgataagtaatgtttcagtcagaagttccagagaagggtgg

SEQ ID NO: 86 - DNA, 2459 bp, Zea mays
cctcccgctgtcccgcaagaacacgagcaggaggcgtggccgtggcagccggtttgacccgcccccgagcgttataagctgtttctccgggaacgtcttgtcgcgcaagtcgctcgcgccggccgcctccacctgcttgctcggtctcagattcccgcgcgcgaaagcgtggaccggacagccggcaggcgctcctttctttcattccctgtcgtggtctctcgtgctctccgtccgttctaacttctgcggcgcgcgaaggtactgtgggaatcgctgctctttccttgattccggcggcggcggaggtgcgcgggttccgttcgtcgcgccgtgggggtgcgagggaggcgccgcgcgcggcctcggattcgatcggacacagcgtccgtcgcgcggcggcggcggtggccgacgacggatggagtcggtgaaggggtgggtggccgccgactacgcggcggagcccatggcgtcggtgcagcactcgttgcgcgtcgcctacgtggtcttctccttctgcgccgccttcttcctcggcggcatcaaagcggtggtggtcgggcccgttgccgccgccgtgatgatagtgggcaacgtcggcgtcatactcgtgctcttcccggcgcacgtctggtgggcaatctactcgctcatcaagaccgaccgcatcaacgcgggcctgaagctagccgtgctcttggcgctgcccgtgctgttcggcctctggctggggctgggcatcttgggcagcgcgctggtgggtctcgggtacggcttcttcacgccgtggatctccaccttcgaggcgttccggcaggaaagcgaggccaagaagttcgtgcacggcattgtggatgggacgtggggcacgatcaagggcagctgcacggtggtcagggacttcgcggacatctgcttccactcctaccctgtctacctcaaggagctgcgcgagggctcccagaatcgtgagccccattccataaggttgctggacgtgccctcatgcatagtcgtcgctctcctcgggctagtcgtggacataccactttacacggtgattgcgctggtcaagagcccctacatgctcttcaaaggctggcagaggctgctgcacgaccttataagccgagaaggcccgttcctcgagacggtctgcgtgccgatcgccggcctggctatcctgttctggccgctggtggtggtcgggagcgtcctgctggccatcgtctccagcatctttgtggggctctacggagcggtcatcgttttccaggagaggtcgtttcagaggggcgtttcgtatgtcgtggccatggttgcggagttcgatgagtacaccaacgactggctctacctccgtgaaggaacagttctcccgaagccgtcctacagaaagaggaaaccgtcgaactccacggaattctcggtgagaacaaacgcctccggcggcaaaggagctgaccaccctcctggccccagtgaagcaccggcaatgttggttccgaatctggcgcctgcgagatcagtgagagaggctatacaggaagtcaagatggtccagatatgggagaacatgatgaagtcatgcgagcagcgggggagggacctcctgaaccagaacgtgataacggccgcggggctggcggagtggctgaggggggcgaaggagggcgggcaccacgagaccgtgagcctgggcctgccgtcctactcgctgctgtgcaccgtgctgcagtcgatcagggccgggtccgggggcctggtgctgggcagcttcgaggtgaaccagcacaaccggccgcaggaccggctgctggactggttcttccaccccgtgctggtgctcaaggagcagatacaggcgctgaggatgaccgaggaggaggtcaggttcctggagaagctgaccgtcttcgccggcaacgtcgcgggcgctggcgctggcgggtgggagaacggcgccgggatgatggtggtgccccaggaccctgtgaggctggcgcagatccaggccatcagtagaaggctggttgggattgtgaggagcctgtccaagttcccgacgtacaggaggaggtacaggcacgtcgtgaagctgctcatcgcctactccgtcgagagggagagctcgggcaggtcgtcggcttcagggcgctcggcttcctactttgagataacacagctggacgtgtagtatagtttgggaagcgttctccgattgtaattaagctgttaatttctaggatcaggtagtagctgtcagtgccttcgtgtgtttgaagcctagctggtgaggtttttgtagaacactagtgcatggttacaggagaaaggcgctccattgcagatgctgatcaggcgcgttcacgtgccaaaagcttcagacaattgtacacattctcttttgttctgtatatagcctgtaggttcaatgcacatgtgttgttcttttc

SEQ ID NO: 87 - DNA, 1670 bp, Zea mays
gcttctccagttctcctgcactctgctccccatattttatcccttcggagctcggatcagacgcttgtgaatcctggtcatcattcatggagaagaaggcagctactacagaggaaccccttctcgcgccgcggtccgagcacacggtcgcggcggaggccaagcggctgctgagcctggcggggccgctggtggccagctgcatcctgcagaacgtggtccagctggtttccgtgatgttcgtgggccacctcggcgagctgcccctcgccggcgcgtccctggccagctcgctcgccaacgtcaccggcttcagcctcctcgtgggcatggcgagcgcgctggacacgctgtgcgggcaggccttcggagcgaggcagtacggcctgctcggcctctacaagcagcgggccatgctggtgctcgcgctcgcctgcgtcccgatcgccgcggtctgggccaacgccgggcggatcctcatcctcctcggccaggaccgcgacatcgccgcggaggccggcgcctactcccggtggctcatactgtcgctcgtcccctacgtcccgctcgcgtgccacgtccggttcctgcagacgcagagcatcgtcgtgccggtgatggccagctccggcgccaccgcgctgggccacgtgctggtgtgctgggcgctggtgttcaaggccggcatggggagcaaaggcgcggcgctgagcggtgccatctcctactccgtcaacctggccatgctggctctctacgtcaggctctccagcgcgtgcaagaggacgtggaccggattctccacggaggccttccgagaccttctccggttcaccgagctcgccgtcccgtcggcgatgatggtctgcttggagtggtggtcctttgaactgcttgtgcttctctctggtctgctgcccaatccgaagcttgaaacctcagtactgtcaatatgtctaaacactggcgccttgctgttcatggtgccgtatggtctttgcacagccataagcacacgtgtttcgaatgagcttggtgccggcgagcctcaagcagcgaggctagcagctcgagtggtgatgtgcatcgccctgtctgcaggcttgctgctcggctctaccatgattctcctgcgcagcttctggggctacatgtacagcaacgaacctgaagtcgtcacgtacattgctaggatgatgccggtcctggcgatttcgtttttcacggatgggctccacagttgtctatcaggagtgctgactgggtgcggtcggcagaagattggcgcgcgcgtcaatctcggtgcgtactacttggccggcattcccatggccgtgctgcttgcatttgtgcttcacctgaatggaatgggtctgtggcttggcatcgtttgtggcagcctcaccaagcttgtgctgctcatgtggatcacactgcggataaactgggagaaagaggcaaccaacgcaaaagaaacggtgttcagttcatctcttcccgtagcattatagagctgtatcctatatatgtgcagctggacgtaacaacaccacaacatgaaaaggctctattgctgcatgctgctacactaccttcccaattgagagacaatatgagttctatgcgttctctaatacgttacttagtatacatattttgttattaaatat

SEQ ID NO: 88 - DNA, 1364 bp, Zea mays
tacttgagaagcaagaaaccgtgggtgtgagtgtgacaaccagaatgaagtcagcaatgtcctcatttcaacacacaaacattatctatctctattattcatagacagtcatggcaccgagctgcggttgccatcttgttcacgtcactgccttcacaagcccttgctacttttttcagatctaaatctgaagcaacggccagaggaactcaggttggattggacagtggtccgttccattgggattgggtgggtctggggacctaggcagaccagatggccgggctattcaccgagcaggctgctgtgtacgccgcagcacggccggcgtacccgaaggatctgtttgccaagctctcggcgctcactgctcaccaccgccgcgcttgggacgtcggtactggcaatggccaggcagccatcggtgtcgcggagcactacgacagcgtggtggccacggacgtgtccgcggaacagctgcggcacgccacgccacaccccaaggtccggtacctgcacacccgcgacgccacgccgggggaggaggacctcgtcgccatgctgggcggcggcgaggccagcgtggacctcatcacggtggcacaggccgtgcactggttcgacctcccggcgttctacggcgccgcgcgccgcgtcctgcggaggcccggcggggtgatcgcggtctggggctacaactaccgcgtgagccccgtggaggacatgatggcgcgtttcttcagcaccacgctgccctactgggacccccgagctcggtattgcactgacggataccgggacctgccgttccccttcgaggacatcgggctcgggaaggaaggagagccggcgagcctcgacgtggagcacgagatgtcgttcgagggcctgattggcatgctgaggtcctggtcggcggtgacgacggcgaagcagcagggcgtggacctgctgggggcccgcgtcgtgaaagagctggaggaagggtggggtggggcggagctggtgcggaaggtcacatacaaggccttcctcctggcaggcaccccggggcccatggctgatgagtaatcaatgaggacctgtttggaaatatagttttctcgttctacagtatttcaatactatagtatgtcgtatgttataacataaaactgtagttttagcaaaactaaagtaaaatcaaagtagttcttcatacatagcactgtttggtagcatatagtttttggcttatataaataaggaagataagtttaaattcaaatagctacaacttatgatgggctgcatcatcggtaagacaagtttaaattcaaaacagtctgttgtaaccatctgagtatcgaagttcacaaagttga

SEQ ID NO: 89 - DNA, 1870 bp, Zea mays
ccacccaacaacagcacagcaacccagtgatcaattcaagcaacacaccgacgaagcaagcaaagccaagcggaagcggtcagcgtcagaatagtatggcggtgtccgcggccaagatggccgtcgccacggccgtctccttagccgtgcactggctcctccggtccttcctccaggcgcagcaccctgcgctgggcctgctcctcccgaccgtcgtcttcatcggcattgccgcgtctggcaatgccgcaggcgctgccaacgacgcgccgccggggccgccggccgtgccggtgttcggcaactggctgcaggtgggcaacgacctgaaccaccggttcctggcgcgcctgtccgcgcggtacgggcccgtctttcgcctccgcctcggcgtgcgcaacctggtggtcgtctccgacccgcgcctcgccacggaggtgctgcacacgcagggggtggagttcggctcccgcccccgcaacgtcgtcttcgacatcttcaccgccaacggcgccgacatggtgttcaccgagtacggcgaccactggcgccgcatgcgccgcgtcatgacgctgcccttcttcaccgcgcgcgtcgtgcagcagtacaggggcatgtgggaggccgagatggacgccgccgtctccgacgtcgcctccgcggcccagcgcgccgccggcctcgtcgtgcggcgcaggctgcagctcatgctctacaacatcatgtacgggatgatgttcgacgcgcgcttcggctccgtcgacgaccccatgttcgtggaggccaccaggttcaactccgagcgcagccgcctcgcgcagagcttcgactacaactacggcgacttcatccccgtcctgcgcccattcctgcgcggctacctcgccaggtgcaaggacctgcaggccaggcggctcgccttcttcaacagcaactacgtcgagaagaggaggaaggtcatggacgcgccgggggacaagggcaagctcaggtgcgccatcgaccacgtcctccaggcggagaagagcggcgagatcaccccggagaacgtcatctacatcgtcgagaacatcaacgtcgccgccatcgagaccacgctctggtccatcgagtgggcgctcgcggaggtcgtcaaccacccggcggtgcagcgcaaggtccgcgacgagatcaaggccgtcgtcgccgaccacgagcccatcacggagtccaccatccaccgcctcccctacctgcaggccgtcatcaaggagacgctgcgcctccactccccgatcccgctcctcgtcccgcacatgaacctcgaggaggccaagctcggcggctacaccatccccaagggctccaaggtggtggtcaacgcgtggtggctggccaacaatccggagctgtgggacaagcccgaggagttccggccggagcggttcctaggcgaggagaagagcgtggacgccaccgttggcgggaaggtggacttccgcttcctgccgttcggcgtgggccgccgcagctgccccgggatcatcctcgcgctgcccatcctcgcgctcatcgtcggcaagctcgtgcgcagcttcgagatggtaccaccgcccggcgtggagaagctcgacgtcagcgagaaaggaggacagttcagcctgcacattgccaaccactccgtcatcgccttccaccccgtctctgcatgatagattgattgatagccaaccacgaatgctgcgcgtcgttttctgcatatcaatgttaccctacatacccagtcatttttttcgcttttatttactagccatttctcaggtataagtatctccaacaacaacagtgtgactgtttgaaaatgagtataatttataaaaattaaggcact

SEQ ID NO: 90 - DNA, 1009 bp, Zea mays
agcacgcacttgcaaagaactcgagagcttgattcaatcataccctacactgccatggagtccagcaggatgcgctgctgcatgctgcttgttgtttccttggctctgctgctcccgctgggcatggccgcggactccatcggcagctactgctcaggaagcagctacgctggcagcagcaaggccgtggccaacatcaactccgtcctcgccgacctcgtcgcctcggcctcctccaccgggggctacgccacgtccaccgccggcaagggcaacaacagcatcatctacggcctcgcgcaatgccgcggcgacgtctccgccagcgactgcgcgtcctgccttgccgacgccgccaagcagctccccagcacctgcagctacagttccgacgcgaggatatggtacgactactgcttcatgcggtacgagaacgccaacttcttcgggcaggcggacacggacgcgggcgtgatcctggtgaacgtgcaggccatggacaacccgaaggcgttcgagaaggcggtggggaaggtgatgggcaaggcgacggcgcaggcgtcggcggcgggcagcgcggggctcgggcgggacaaggagcagtacacgccgttcgtgtccatctacgggctggcgcagtgcacgcgggacctcgcgccgctgacctgcgcgcagtgcctgtccacggcgctgtccaggttcggcgactactgcggcgcgcagcagggctgccagatcaactacagcagctgcagggtgcgctacgagatctaccccttctacttcccgctcgccggaaagggcggcggcctcgccaccaccgacatgacgaagaacaccaagatcgtcgtgcgtccttaattagcctgaagtgacttgtgtgccttaacgtagggtaaagtagccttgcgttagctagcaataaagatgtgcaactgtatgtgttaagagcttatgcagtgtaagtacatctctgcgtcgaagcaatagtattgatatgttaaactac

SEQ ID NO: 91 - DNA, 661 bp, Sorghum bicolor
gccagtagcagttccctatataaagcggccgcctgcaggaaaattggcgaagacaccaccatttcacattgccgtggtcatcgagatcagatcgatcgagtcagctcaaggggtgaagcaggcatggctgcatccagattctacgtcacctgcgccctcctcctgatcggtgtcgtgctgctggggcagcaggggatagagggcgccgttgcctgcccccagtactgcctcgaagtggactacgtgacctgcccgtcgtccggctccgagaagctcccggcgaggtgcaactgctgcctggcgcccaaaggctgcacgctccatctctccgacgggacgcagcagacttgctcttagctgggatggctgatctggaccaaagaccaacctgctgctttgcctgcgggttttggcaaataaggccttgtttagttcccaaaaaaatttgcaaaattttccagattcttcgtcacatcgaatctttagacacatgcatgaagtattaaatatagacaaaaataaaaactaattgcacagtttggtcgaaactgacgagatgaatcttttgaacctaattagtccatgattggacaatatttattaaatacaaacgaaagagctacagtgtcgattttgcaaaatattttgaaactaaacaagg

SEQ ID NO: 92 - DNA, 3375 bp, Sorghum bicolor
acactgatccatccccacgtcggggagccgcggggcagtcccgtcatttcagcgcgcgggcgagccatgtggataaggcccatggccctgatgatggccatgccgtcacaccgcctactcccggtcgccccgtccgttccttcttcctcgcttcacacacgacgacggagcgggccggggggggcacacgcacacgcatatatccagcttgccatatttataccacctctcctcctccgtccgcggccgagacccacctcggccattcttatccccagaagcttcgccaaaagtgatcgatccgtctccacaagggaccagaccgcccgccggcggaacccgacgacacactcctcgtcgcgttcgcggcgcttctcttctcatctcttcatgcgccatcgccgccgcctccacctctgcgacgccgcccacagatagagcagcaggacgggggcgatgccttcgctctcctgccacaacctcctcgacctcgccgcggccgacgaggtgcccctgccgtcgcccacgccgcttcgcctcccgcgcgtcatgtccgtcgcgtccccggcctcgcccacctcgccatccccggccgccccgccgcgccgcgtcatcgtctcccaccgcctcccgctccgcgcgtcgccggacccggccgcgccgttcgggttcaacttctccgtcgactccggcaccgtcgcgtaccagctccgctcggggctgcccgccaacgcgcccgtcctccacatcggcaccctcccagcggccgcggcggaggccgcctcagatgagttgtccaactacctgctggccaatttctcgtgcctgccggtgtaccttcccaccgacctccaccaccgcttctaccacggattctgcaagcactacctctggccgctcctccattacctgctcccgctgacgccgtcgtcgctcggcggcctcccgttccagcggacgctctaccactccttcctctcggcgaacagggccttcgccgaccgcctcaccgaggtgctgtctcccgacgaggacctcgtctggatccacgattaccacctcctcgcgctcccgaccttcctccgcaagcgcttcccgcgcgccaaggtcggattcttcctccactcgcccttcccctcgtcggagatcttccgcacaatccccgtgcgggatgacctcgtccgcgccctcctcaacgccgacctcgtcggcttccatacctttgactacgcgcgccacttcctgtccgcgtgctcgcggttgctcggcctcgactaccaatccaagcgcggttacatcggcatcgagtactacggccgcaccgtgacggtcaagatactccccgtcgggatcgacatgggccagctcagatcggtggtctcggcgccggagacggaggatgtggtgcggcgggtgaccgagacgtacaaggggcggcgcctcatggtcggcgtcgacgacgtcgatctgttcaaggggatcgggctcaagttcctggcgatggagcagctgctcgtagagcaccgggagctccgcggccgcgccgtgctcgtgcagatcgccaaccctgcgcgcagcgaggggcgcgacgtgcagggcgtgcaggacgaagccagggccatcagcgcccgggtcaatgcgcgttttggcacccccggctacacgccgatcgtgctcatcgacggcccggtgacgcctcaggagaaggctgcctactacgcggccgccgagtgctgcgtcgtgagcgccgtgcgcgacgggctcaaccggattccctacatctacacggtgtgccggcaggagagcaccgcgctcggagacgacgcgcccaagcggagcgtcatcgtgctctccgagttcgtcggttgctccccgtccctgagcggcgcgatccgcgtcaacccctggagcgtggagtccgtcgcggaggccatgaacgccgcgctgcggatgtccgaggccgagcagcggctgcggcacgagaagcactacaagtacgtgagcacccacgacgtcgcctactgggcgcggtccttcgactcggacctgcagcgcgcctgcaaggaccatttctcgcgccggcattgggggatcgggttcggcatgagcttcaaggtggtggcccttggccccaatttccggcggctctccgtggagcacattgtcccgtcatatcgtaggacggagaaccggctgattctcctggactacgacggcaccgtgatgccagagaattccatcgacaggacgccgagcagtgaggtcatctctgtgttgaatcgtctgtgcgaggaccccaagaacagagtgttcatcgtgagcggtcgggggaaggacgagctcagcaggtggttcgccccctgcgagaagctgggcatcgccgcggagcacggttacttcacaaggtggagcagggacgcgccatgggagatctcaggattggccgccgacttcgactggaagaagaccgcggagcctgtgatgcagctgtacacggaggcaacagatggctcctacatcgagcacaaggagagcgccatcgtctggcaccaccacgaggcggatcctgacttcggttcctgccaggccaaggaactgctcgaccatctcgaaaacgtgctcgccaacgaacccgtggtggtgaagagaggccagcacatcgtcgaggttaacccccagggcatcagcaaaggcgtggtcgtggaaggcctcctgtcgtccatggtcaaaacggggaagccgccggacttcgtgctgtgcatcggcgacgaccggtcggacgaggacatgttcgagagcatcgtgtgcccatccaacagcagcctgaagctcccggccagcagcgaggtgttcgcgtgcacggtgggcaagaagccgagcatggccaaatactacctggacgacaccgtggatgtgatcaagatgctcgacggcctggccagcgcgccgtcgcagcggcctaggccggcggtgcagctcagggtgtcgttcgaaggttcgctctgaggaacacacacagcgctagcagtgaacatcgaggaagaataaccaatgatgatgatgaacatgattcagacagtgtggtgtaggattagctgcagttacaggatcgacagggtttcttttttctttcttctacattgctacccgcaaatcgttcgtgcctgtatatgcccgtatgataatatgcaaagaatgtttcgaccacctttgtatatgtagttgacgatgacgatgaaatcagaaaaagagaaggaaaaaaattgattctttcactttgcttgccctgttggcagtcccattcagtctttcacctcgatgcattatagaatcctggtccggtatggatagctgcaggatagagcctgatcttgt

SEQ ID NO: 93 - DNA, 1803 bp, Sorghum bicolor
ggaataatctccacaagtacagtacaccatcacatgctgggtcgaaggcatgctccaagccatacagtacacaccgatacacgggacctatccaccacgctctgtataaatggaataatctccacaagtacagtacaccatcacatgctgggtcgaaggcatgctccaagccatacagtacacaccgatacacgggcgcgcgcctagtcaccaaagcgcatgcatatgcttcgccttcgccttcgccagggggcaatgcagagcgacactctggcctggaaagaagcgcgggatataaaaaggagatctagctgtatgggacaatagggaaaagcctagaaaaggatcgaacagcgggcgaccagttcggggcacccgcgctgtggtggtaggccaaggagtaatttcgcaaccaattcccaccagcggcagggatgggttgtgatttctgaagcgcctgggctataaggaagggtggtattattttgactctcttgaagccctcctccccccctctcttccatgggagactccaaagaaagagaacctcttccacggctgcttgatcttatcccggatgggaaacaatgtaaggggagggaagcacaaggcgcaggaagatcatcaaggaacacaggctttgggagcgaggaggacaagcagctagagctcaaactcggtcctccgggtctcatcgaagaagggacgacagcagcagcgtcaagagggatacagcgagagattccggctctctcgcttggttgcttcccacataaaccctcctccaagcctgcaataaacactactgcgactgggacaaagagggggttcttagacaccattgaggccaaaacagaaggtcgtgatgagcagaagcagcaggctggagctggatgtgggaaggaactagcactggaccagaagataacagccgcgagcgagagaaagaaaggattctgcccgccaacatcacagcatgcccctcctcctgctgctgcaactgtgcacgacagatcacacgcccagggaagaaggtcttcagctccggttgtcggttggcctccagtgagatccttcaggagaaatcttgctcatggcagttcatccaaacaatccattgagccacaaaatactgaagctagcatgaaggagaagcttgcctgcaagaagaatcctcttgtaaaaatcaacatggatggaatccccattggaaggaaagtagaccttggagcctatgacagctacgagaggctatcattgggcgtcaaagagcttttccatggttttcttgaagctcaaaaggatctatctagtgctggaagtacacagccaggggccactgaaaaaatattttctcaattattggatggatctggtgaatatactctagtttaccaagacaatgaaggagacaggatgctggtaggggatgtgccgtggaatgtatttgtgtcaactgctaaaaggctgagggttttgaggagctcagagctttcccatggtttgattgcagtagctcctagaagaggaccagattgctgaaagcctgaaacagtgtcaaaattctatcatttggaatgtgagcaaactgaacccggaccattccccttctgtgatgtgatgatacctatttttttccctactaatctaatgagatgaagtagcatttcagatgcatggagaggtcctggatattttgtaaattaggctaccatgtgattcgttgctgtagagtaatgttctaatgtaattcgcatgggcattgaacttctacgataaagttcgcagatgcaagatctagca

SEQ ID NO: 94 - DNA, 1122 bp, Sorghum bicolor
cgcgttgctttgctcatggctcatccatccttgtccttggtgactggatcagcgacgcgcggacagccttcctctagtctcgtgttgatccatccatccgtccgccaagcagaaacgatacatatacatatcccccacccacccgtgcgtccacccaccaccattgtccaaagaaccagactaccagagcacgttcatatcccaatcccatccatcgtctagctcggaccaagctttggctttgggaccaaagttttggtggccaaccggccaaccagccgctgacgatggcggcgatgtggtggtgggcgccgctgccggcgtggctgagctccagcgcgctatggttcctcgtcgtcaacgcggttgtcgccgccgtcgccgtcctctccagggcacggccgccgctgccgtccccacgacgacgcgggtcaggggtcacggtcacgcggagggcgtcctccgcggtgatgcagcgcctccgctccttgtccatcttctccttcccctccgcctgcttcaacaccaccacgccgctcccgcaccctgaccctgacgccgcccaagaaacagaggagccggcggcggcgacgacgacgcccaagacaaccaagccgtccccgtccccacgcgcgctcccactcccgccgtcgccgctgtcgtcgtcagggcgcgtaccgccggcagacgacgacgagaccaccgggatgagcatggacgaggcctacgcgctggcgctgcaggcgcgccggcggccggagcgggagagggaggaggaggccaggaggtccgaggtggacgccaaggccgatgagttcatccgcggcttcaaggaggacctgcgccagcagcgcctcaactccatcttcaactacacccagatgctcaagcagcgggcactcggcggcgccgccgccgcccgcaggcagccagatcagctttgagtcacgtgatcgatttgttcatttatttaagatatattggtctgcgttttcagggagaccaaatcagttttgagttgctgttctagtgttctgtacatagacatagggctgctttcaacagattgtttgtatagtttgaacatattgtttgcatggttttatttcttcttctttcgca

SEQ ID NO: 95 - DNA, 1875 bp, Sorghum bicolor
caaccatcaacaaaatcacacagaaaagcagaccaatagcgaacacagacacagcagcctctcgccgtgtaacgcaacaggcagcggcaagcaccagtgctaagccaaaacaccccacaacacacgcagatctcgatcactaacgaccccatactaccatgggttctctcggcagcgccgcgcagcagccgcacgccgtgtgcctgccgtacccggcgcagggccacatcaccccgatgctcaacgtggcgaagctgctccacgcccggggcttccacgtcaccttcgtcaacaccgagtacaaccaggcgcgcctcgtccggacccgcggcgcggcggccgtggccggcctcccgggcttccgcttcgccaccatccccgacggcctgcccccgtcggatgacgacgacgtcacgcaggacatcccctcgctgtgcaagtccaccacggagacctgcctcgagcccttccgccgcctgctcgccgacctcaacgactccgcggccacgggctgccacccgcccgtcacctgcgtcgtctccgacgtcgtcatgggcttctccattgacgccgccaaggagctcggcctcccttacgtccagctctggaccgccagcgccatcagcttcctcggctaccagcactaccgccgcctcatgagccgtggcctcgctccgctcaaaagcgtcgagcagctgacgaacggattcctcgacacgccggtggaggacgtgccggggctacggaacatgaggttccgggacttcccgagcttcatccgcaccacggacccggacgagtacatggtgggctacgtcctccaggagaccgggcgctcggcgggggcgtcggccgtgatcgtcaacacactggacgagctcgagggcgaggcggtggcggccatggagtcgctgggcctggcgcgcaaggtgtacacgctgggcccgctcccgctgctggcgcgcgaggacccgcccaccccgcgctcctccatcagcctcagcctgtggaaggagcaggaggagtgcctgcggtggctggacggccgtgacccgggctccgtcgtctacgtcaacttcggcagcatcaccgtgatgaccaacgagcagctggtggagttcgcgtgggggctggccaacagcggcaggccgttcctgtggatcatccggcgcgacctcgtcaagggcgacaccgccgtgctgccgccggagttcctggccgcgacggccgaccgcgggctcatggccagctggtgcccgcagcaggcggtgctggaccacccggccgtggccgcgttcctcacgcacagcggatggaactccacgctggaggccatgtgcggcggcgtgccggtcatcagctggcccttcttcgccgaccagcagaccaactgccggtaccagtgcaacgagtggggcgtcgggatggagatcgacagcaacgtccggcgcgacgccgtggcgagcctcatcactgagctcatggacggggagcgggggaaggagatgaggagaaaggcactggaatggagggacatcgcggtcgaagtggccaagcccggcggcacgtctcaccggaattttgatgacctggttcgcaacgtgctcctgcccaagaactaggcgattagctccgtctttgcacggtgtttctgtcagtgtcgtgtgattttgtccctttggtttggtgggtgatggtggagagatccgtgtggttgtgtaaacaataatagtatatacaagcgttcaatttttgtgcaccttgtgtttacatggattattggcactgggtgtggagcatcgagcggaaggcactacaataataggattggtcattggtcgagcggaaggcactactaaactaacggatgacgac

SEQ ID NO: 96 - DNA, 4044 bp, Sorghum bicolor
cgcgagaatcaggcgctcctccccaagaggcaggcaggcgtgtacgcagtagacacacacacaaagtcgcgagcaatggaagcagcgggaggtgcgaaagggagggatggcgtggagaagaaggaagaggagaacggcaacggccacggcggcggcgacgccgtgaagaaggtgccgttcacggggctgttccggtacgccgacggcacggacgtgctgctcatgctcctcggcacggtggggtcggtggccaacggcgtgtcgcagcccgtcatgacgctcatcttcggccaggtcatcaacgccttcggcgacgccaccaccgacgacgtcctccgccgcgtcaaccaggcagttctgaactttgtctacctaggcattgcaacagcggttgtttcctttcttcaggtgtcatgttggacaatgacaggagaaaggcaggcaacacgcatccgatctctatacctaaaatctgtcttgagacaagaaatagcattcttcgatgtagaaatgacaactgggcagatagtttcaaggatgtctggtgataccgtgttagttcaggatgccattggtgagaaggtcggcaagtttcaacagcttgtggcaaccttcgttggtggtttcgtgatagcattcgtaaaaggatggcttctatctcttgtcatgttggcatgcatacctcccgttgtcattgctggtggaattgtctcaaaaatgcttgctaaaatatcaaccaaggggcaagcatcatacagtgatgcaggcaacattgttgaacagacacttgggtctataaaaacagttgtctctttcaatggggagaaacaggctattgcattgtataataaactcatacacaagtcatacaaggctgctgttgaagaaggaatcaccaatggttttggcatgggttctgttttcttcatatttttctcaagctatggtttagccatatggtctttaggtaatgcaacaccctgcatggcagcctttgcaggaggacaatctgcggcatacagattgttcacaacgatcaagaggaaaccagagattgacccagatgacccaactggtaagcaactagaagacatcaagggtgatgttgacctaaatgacgtgtacttcagctacccagcgagaccagagcaactagtatttgatgggttctcgctacatgtgtctagcggcactacaatggctatagttggggagagtggaagtggcaagtcaactgtgatcagtcttgtagagagattctatgatccacaagccggtgaggttttgattgatgggattaacatcaagagtttgcagcttgattggataagagggaagattggtcttgttaaccaagagccattgctctttatgacatctatcaaagataatataacatatggaaaagaggatgcaacaattgaggagatcaaaagagcagctgagcttgctaatgcagcaaatttcatcgataagttacccaatggttatgacacgatggttggccaacgtggtgctcagctatcagggggacaaaagcaaaggatcgctattgcaagagcaatcatcaaaaaccccagaattcttttgttagacgaggctactagtgcattggatgtggagtcggagcggattgttcaggaggcactaaataggatcatgctggataggacaacacttgtggttgcacatcgcctaagtactgtgagaaatgctgattgcatatcagttgttcaacaagggaaaatagttgaacaaggtccccacgatgaactgataatgaaccctgatggtgcttattctcaacttattcgtctccaagaaagcaaagaagaagaacagaaattagatcatcacatgtctgattcaaggtctaaaagtagaagcctctcactgaagcgatcaataagcagaggttcagcgggaaacagtagtcggcattctttgaccctcccctttggcatgcctggttcagttgaattgcttgaaggcaatgatgcaaattgggaggatgagaaagaccaggctcgtgatggtgaggccccaaagaaagctccaatgggacggctagctagtctaaacaagccagaggtgccgattcttttgttaggatcgctagctgctggagtccatggagtgcttttcccaatgtttggtctaatgatctccaatgccatcaaaacattctacgagccgccacaccaactaaaaaaggatgcaagcttttggggtttgatgtgtgttgtgttgggtattgtatcaatactatcaataccagtggagtatttcttatttgggatagccggggggaagcttatcgagcgtgtccgtgccatgtcgtttcggagcattgtgcaccaagaagttgcttggtttgatgatcccaaaaattccagtggagcacttggcgcaaggttgtcagttgatgctttgaatgtccgacgtttagtgggtgataacttggccttggcagttcaggtcatctcgacactaattgcaggatttgtcattgcttttgtggcagattggaagctcacattgatcatcctttgtgtgatgccactatcgggtgttcaaggttatgcacaagtgaagttcttgaagggtttcagtgaagatgccaagatactgtatgaagacgcaagtcaagtggccaccgatgcagtcagcagtatcaggactgtagcttctttttctgctgaaaaaagagtgacgacaatttatgaagataaatgtgaagcctcaaagaaacaaggagtcagaacaggaatggttggaggccttggttttggtttctcattcttgatgatgtaccttacatatggactttgtttctacgttggagcacagtttgttcgtcacaacaaatctacttttggagatgttttcaaggtattttttgcactgatgttggcaacaattggaatatctcaaacaagtgcattggcttctgattctacaaaggccaaggattcagctgtctccatattcgcattattggacagaaagtccaaaatcgactcaagcaatgatgaaggttcgacgctacatgaggtcaagggcgacatcgatttccgacatgtcagcttcaagtatccaagccgcccagatattcaaatatttagcgattttaccttgcacattcccgctggcaagactgttgcacttgtgggagagagtggcagtggcaagtcaacggtaatctctttgttggaaagattctacaaccccgactctggtactatctcattggatggagtagagatcaaaagcctaaaagtcacttggttaagggaccaaatgggtctggtgagccaagagcctattctcttcaatgacacaatccgtgccaacatagcttatgggaaacatggggaagtcactgaggaggagctcatcaaggccgcaaaggcagccaatgcacatgagttcgtatcaagccttccccaggggtatgacaccactgttggagagaggggggttcagctatctggtggccagaaacagcgggtagccatagcaagggccatactaaaagatcctaggattctacttcttgacgaggcaacgagtgccttggatgctgagtctgagcgcatagtgcaggatgccttggatcatgtaatggttggcaggacaacagttattgtggcacaccgcctctccacgatcaaaagtgctgatattatcgcagttcttaaggatggtgtgatagtggagaaaggaagacatgaggcactcatgaatatcaaagatggattctatgcttctctagttgaacttcgttcagcctcatcatagtacctaggttaagaatttgttctgattattaggcattatacatactttacaccttttgtagctctccttactgtttctgtagtttgggggtagtatgaagtcattgagatttgaagaagaattcgagaagttaacatttctttgtaattatcactcacagtatgactgtaaggcatgattttgtattgtacctatgtcattgctgtgtcaatatcaccatagagtctccacataacttatgat

SEQ ID NO: 97 - DNA, 1264 bp, Sorghum bicolor
accgcacagccagtcggtggcacagagcactcgcttcacttctctgcctccgctagcgcaacgccgtctgcttctcatcacttccatggccgccgccgcctcggtggctccgtccggcccagtcccgttcacggaagtcgacgatggcacggtcccggagcacactcccaaggaggagttcggcgaccttgtggcctccctgccgcgcagggagcagtccatcctggagctgcgtctgtaccagggcttctggctgccggagcactgggtgcccggaaccatcgtgttccagcgccgcttcacgccgcgccccgacgacgtgatcctcgccagctaccccaagtgcggcacgacatggctcaaggcgctggccttcgccacggcggcgcgtacggcgtacccgccctctgacgccgggcacccgctccgccggatgaacccgcacgactgcatcccgttcatcgacgagatcttcgccggcggggaggacgcgaagctcgacgcgctcccgtcgccgcgactgatgaacacgcacctgccctacgccctgctcccggcgtccgtcgtcactgccaccggcgggtgcagggtcgcgtacgtgtgcagggaccccaaggacatggtggtctcgctctggcacttcctccgacgcaccaagccggacctctcgttcgccgacacgttcgagtccgtctgcgacggcaccgtggcggccggcccggtctgggaccacgtcctctcgtactggcgcgcgagcgtcgcgaccccggacagggcgctcttcctgaagtacgaggacctgctgcgggaccccgccggcaacgtgcggcggctcgccgagttcatgggctgcccgttctcggccgccgaggaggccgccggcaacgtcgcggccgtcgtggagctgtgcagcttcgacgagatgaagggactggaggtgaataggcctggtggtggcaccgcggggaagtaccgcgccatgccgcgcgacgcattcttccggaagggtgtcgccggggactgggcgaaccatatgacgccggagatggcggcgcggctggaccagatcttccgtgacaagctccaagggacggggctcgccttctcgtaatgcttaacaatcatttcgagacgtggacgcttttggatttgcgattctcttggcagttttgcgtgtctacatttccggaggaatatatggtaatgcaaatgtgtctacatgagtggaataaagagcgattttatattggtcacacgattcgat

SEQ ID NO: 98 - DNA, 1011 bp, Sorghum bicolor
actagagaagagaagacccaaccaaaaagccatcagcccatcaacaccatgtcgacgcccgcgcttgcgacggctgccgagggagcgacgcgcatcatcctggtgcacggcacgggccatggcgggtggtgctggtaccgggtcgccacgctgctccgcgccgcgggacaccgcgtggacgcgccggacatggcggcgtctggcatcgactcgcggcagctccgcgacgtgcccaccttcgaggactacacgcggccgctgctcgacgcgctccgggcgctcctgccgggagagaaggcggtcctggtcggccacagcttcggcggcatgaacatcgcgctcgccgcggagatgttcccggagaaagtggctgccgccgtgtttgtcaccgcgttcctgccggactgcaccaacccacgctcgcacgtcatcgagaaggttatcgggtcagactggatggacaccgtcacggatgcagagcacgtcccaccctcggtgttcctggggcctgaattcctacgccacaagctctaccagctgagcccaccggagaactacacgctgtcccagagcctggcccgggtgagctccttctacgtgccagacctgcagagccagacgccgttcagcgagtccaggtacggcgccgtgaggaaggtgtacgtggtctgcaagcacgacctggccataaccgaggcgtaccagcacacgatgatcgccggctgccccgtggaggaggtgagggagatcgccgccgccgaccacatgcccatgttctccacaccggctgagctcgctgggcacctcgcccacgtcgccaacaagtacgcttgataccaaggttttcgtcacaaatgtaaacccgggcgaaaatggaaacctactccagtcatacttcatacttcggggttcggaggccgtcttctaaagattgcttggaacttccaactgtgcacatgtaataagttagaaaatcagcctccaataaagtttctttactaaacttcggtc

SEQ ID NO: 99 - DNA, 2005 bp, Sorghum bicolor
tctcaccttcgccgaaccaaattccaactttcccttccagattttggtcatatgtacaccctcccaagaaaccgatccggagcgttgatgcttcggcgaagttgcgcgtgcggcgtgcccatcccggctgctttcgccaccctcatctagctagcacacacatcgtcttgctataaaaagaggcatcagagaaagctcctgcagctccatccgaacctgtcacctgtgtgtgtgagtcctctgaacgtcttcagttcttcgttctactccaccaaattgccatttaccaagcacaaattaaccacgtcgcaaccgatggaggaggccgtggaggacatcgtcattgccggcgcgggcctcgccggcctcgcgacggcgctcgggttacacaggaaaggggtgcggtgcctggtgctggagtcgtcgccgacgctgcgcgcgtcagggttcgcgttcaacacgtggaccaacgccttccgcgccctcgatgccctcggcgttggggacaagatccgggagcaccatttgctctacgagaggatgattgccttctctgcagctacaggtgaagctgctgcagaagtaagcttaaagattcagggcaaaagcgggccacacgaaatccggtgcgtgaagcgggacttcctgctgcagacgctcgccaacgagctgcccgagggcaccatcaggtactcgtccaagcttgccgccatggaggaagacgacggcagcgtgaagaccctgcacttggcagatggttccatcataaaggccaaggtcgtgatagggtgcgacggcgtgaactcggtggtggccaagtggctgggcctcccgaagccgatcctctcgggccgctccgccaccaggggcctcgccgagtacccggcgggccacggcttcggcccggagatcctgcagttcatcggccatggcttccgctccggcgtgctcccctgctccgacacctccgtctactggaactacacctggtacccttccccggcggacggggacgccgaggagagcgtggccaagatgcggagccacgtggtcggcaagctgcggggcgccaagatcccggcggaggcgctggaggtgatcgagcggagcgagatgagcgacgtggcgtcgtcgccgctgcggttccggtccccgctggcgctggtccgcggaagcatcagccggggcggcgtgtgcgtggcgggcgacgcgctgcacccgatgacgccggagctcgggcagggcgggtgcgccgcgctcgaggacggcgtcgtcctggcccggtgccttggcgaggccttcagccacggccacggccacgacgagcaggatgaggggcggcggttcacggcggcgctggagaagtacgcggaggcgaggcggtggcgcagcatccagctgatcacggccgcctacgtcgtcggcttcatccagcagagcaacaacgccgtgatcaggttcctcagggacaagttcctgtctagactgctgtccaagacgctagtcgccatggcggactacgactgtggcacgctatgattctgccccattggagggatgggctgcaataaataaattaaagtaaaaacggtgaagaattacatggccgtcttgtatatcacatggaacacagagacttttgatcgaactacggtgatgtacggtgtgctgctacgtagtactagtacgtacacactcgttttagaggaaataataaatagtgataaatcggcagtgtcaacagttgactttgagttgtgattgtgaccgaatgaaaggagtctgatcacgctgaggcaacagaaactgtcatagtcacatgcacgctgtgcacatgcatcgatgggcggggattaacaaaccgctttaggccttgtttagttccaaaaaattttgcaaaatagatactgtagcactttcgtttgtttgtgacaaatattgtccaattatgtactaactaggctcaaaagattcatctcatcaattccgaccaaactatgtaatt

SEQ ID NO: 100 - DNA, 1761 bp, Sorghum bicolor
aaaacattccagatttcttgctagtccactttctagctacgcacccgtccttccaatagcgcagcttcgccggcgccggcacgcagctagccatggccatcaaagatgagctgcagccgttgcacatcctcttcttcccattcctcgcgccagggcacctcatcccgatcgccgacatggccgcgctcttcgctgcccgaggcgtcaagtgcaccatcctcaccaccccggtgaacgcccaagtcatccgctccgcggtggaccacgccaacgacgcctcccgcggcaccgatggcgccctggccatcgacatcgccgtcgtgcctttccctgacgtcgggctgccacccggcgtcgagagcggcccggcccttaattccatggaggaccgcgaaaagttctcccacgccgcccagttactccgcgacccgttcgaccggttcttggtggagaatcgccccgacgccgtggtgagcgacagcttcttcgactggtcagtcgacgccgccgcggagcacggcgtcccgcggatagcgttcctcggcatcagcttgttcgcgcggtcctgcagcgacaccatgttgcgcaacaacccagtggaggccgcccccgacgacccggacgcgcccgtgctgcttccgggcctgccgcaccgcgtcgagctgaagcggagccagatgatggagcccaagaagcggccggagcactgggccttcttccagcgcgtcaacgccgcggaccagaggagctacggcgaggtgttcaacagcttccacgagctggagccggactacttggagcactacaccacgacgctcgggcgccgcgcgtggctcgtcgggccggtcgcgctcgccagcaaggacgcggcgacgaggggcgccggcaacggtctctcgccggacgcggacggctgccagcagtggctcgacaccaagccggagggctcggtgctgtacgtgtccttcggcacgctgtcccatttctcgccgcccgagctgcgcgagctcgcacgcggcctcgacatgtccggcaagaacttcgtctgggtcatcaacggcggcgcggagacagaggaatcggaatggatgcccgatgggttcgcggagctgatggcgtgcggcgaccgtggcttcatcatccggggctgggcgccgcagatggtgatcctgacccacccggcagtgggcgggttcgtgacgcactgcgggtggaactcgacgctggaggccgtgagcgccggcgtgcctatggtgacgtggccacggtacgccgaccagttctacaacgagaagctggtggtggagctgctcaaggtcggtgtcggcgtggggtccacggactacgcgtcgaagctggagacgcggcgcgtgatcggcggcgaggtgatcgcggaggccatcggaagagtgatgggcgatggcgaggacgcggaggcaatacgggagaaggcccaggagctcggggggaaggccaggcgcgcggtggcgaagggtgggtcatcttatgatgatgtcggacggttagtggacgagctgatggctcgcaggagctccgtcaatgtctgattggcccatcagtggaagcgagcttcgagtgtccaatgaattgggatagcttggtgggaagagttgcctctctttgaaggtgtctcggcctgtgcgtcggcaactttaggccaggattatcttccatcttaatataaactctctcatttttttttataaaaaaaagtgaaatagtactgctggcttgtttggc

SEQ ID NO: 101 - DNA, 2155 bp, Sorghum bicolor
ctttcttggactattacatagtattagtatatcttctcagtcttatgctactcctatgctataagaagaggcaacccattcattcatactcatgcgcgccacttctgtgcatgacgaataccagctagtcgatctgtgttccgtgtttgacattattattgctgcccaagattgggcggcgaaagtaattaatcaaggggacggaataagcttaagcagttgcgatcgatcggcggccatggccggaggcggcgacgatgcagaggagataacgctggagcacacgcccacgtggatcgtcgcctccgtatgttccatcatcgtcgtcatctccctgctcttcgagcgactgctccacctcctcggcaagaggctaacaaaagggcgccggaagccactgtacgaagccctcctcaaggtcaaagaagagctgatgctgctggggttcatctccctgctgctcaccgtgttccagggcaccacgcagaagatatgcgtccaggagagcgtgatgcgccacctcctgccctgctcgctccccgccgacgacaaggtcaccgcgcacttcatgatcgccggcggcggcacgaggaggctcctcgccggaggaggcgcctccagtgactactgcctcaagggcaaagttccaattctttcggtagaagctattcatcagttacacatatttatcttcgtcttggcagtcacgcatgtggttctcagtgctgttacagttattcttggaatcacacagacaagaaactggaaatattgggaggacaagatccagcaaaacaatgatagtgctcctcaaatgatcaaacatgtgcaagaattccaatttatcaaaagtcacttcagaggtcatggaaaaagatggggaatattcggttggctgcgctctttttttaaacaattctatgggtcagtcactgaggaggactacacaaccctacgacttggttttgttatgaaacactgcagggggcatccaaaattcaacttttacaattatatgaatagagcattggaagtggatttcaagaaagtcgttggcataagctggtacctttgggctatgctaatgatattcttgctactcaatgttcatggatggtacgtctacatttggctatcagtagccccattcattttgctacttgtgctcggaagtaagatggagcatattatcacggagttggctcttgaggttgcccaaaaacatacggcaatagaaggggttctagttgtaactccttcggatgaactcttttggttccatcggcctaaactagttcttctcttgattcatatcatcttgttccaaaatgcatttgaaattgcactcttcttctggttgctggtcacgtatgggtttaattcttgcattatgggagaaccagcatatgctattattcgtgtggtgataagtgtcatcagccaactcttatgtggatacagcaccctacctctctacgctcttatctcccaaatgggaagttcttttaagaaggccattttcgatgaaaatatctccgaaggcctcaccaactgggcagaaaatgctaggaggcgtaatagaatggcaacaacaagtgtcagtgacaattcacctattggtgagggaattcaaatgtcaaataaggcacagagagaatcagcaatggaacaaggaactgcaaggttgatctaatgtggatgtacaagctagtgcacaatgtacatatactaggtaggtaagcgcacttcgccgcacccatagtggctgctggctccaatagacatctctgtattatgaagtgctgctctacaacatgtctgccatgggcacaacattaacatatgtataacatagtgaagagtttagacaactgaattgtgcattagttaaataaatgtgttaatagtaccacatatatgtataggcttttccaagagaagagaaaacagtttgtaaacatcatggcaagagaggttcttgcttcgatttcaagtaggaacattttgttgtgatatagtaaaattcttgtggattgaatgaaaacacctacaggtggcccctcgcctccaaattagtgtatcaagaatcaaaccacatgtaatatatttgtatcacctctgtgctcttggattctctttgcaatctcgttctcca

SEQ ID NO: 102 - DNA, 936 bp, Sorghum bicolor
ttggcattttgcccgctcgctcgcgcgcgtgtgcataaatgatcgacccccgagaccgtagctttgctcattcacaacctgctgctcttgcttggtcgtcgtctctgtagccgatcgatcagcgtagtagccactgtcgtcacagtttctttatttatttcccatcatctgtcggagcacgtaaatcggctgcgggcgatcgaccggcgacgccatgtccaagcaaaagactgtgatcaggctgggcgtacccaacgccaagaaccggtctaaagccatgcagctcgcatccaaagctgtcggagtgaactcggtggccatcgccggcgaagccaaggaccagctggaggtggtaggagaaagcgtcgacatcacctgtctgatcaatcacctgcgcaagaaggtctgccgcgccgacatcgtcgtggtggaggaagtgaaggacaagaagaaggaggaggaggagaagaagaagaaggaggaagaagccaagaagaagaaggcggaggaagataagaagaaggcggaggaagcaaggaagaaggcggaagaagagttcaagaagctctgggcggcgtgcccgccgccgccgtacaacggtggttattatagttaccccgggccgccggcgacgtttgtatgcgaggaacagccagcagcaggctgccacatcatgtgaactggagctgcgtacttaagatggattttgcccggcgtgtatatgcttaatatgtttgtgattttggttctgaacttctgacctctccgtgaatcgtgctgggcgcatgtgcacaaaccatcactggcagttggcagaaatgaaagcaaaccagaaccacatccagatgtaaactatgaaagcatatttcatataagatattaatgatgctcatttgaattcttaagtactcaattcatttttaattataaggcgtt

SEQ ID NO: 103 - DNA, 4933 bp, Sorghum bicolor
gctactcccactcgtactcaggcacacgggatggcgctcccatggtggctcgccaccacggcgtgcgccgcgccgccacccggcccgggctccttcgccgacgcgctcgcgttcctcttcctctccccgtgcccgcagcgcgtgctcctcgccgccgccgacctcgcgttcctcgtcgcctgcctcgtcctcctcgcccgacgacgccttcgccttcgcaggggacagggacacccggcgccggcggctgctcctgctcccgctcccgctcccgaacgcgaggcgctgctgcagcagaagccgaaccatcatccttcgccgccgctctccctccgccacgtgctcgcgctcggggcctccgcggtcttcgcggcggcgtccgcggtcctcctcgcgctcgcgctcctcctcctgccgagcgcgccgtggcgcgccgcggagggagccttcctcgccgtccacgccgtcgcgcacggcgtggctgcctggaccgtcgccgcctcttcgcggagagcaggagctgctgcccacctccgcgtgttctggctcgccaccgccctcggcgccgcgctcttcgctgcctcggcggtggttcgcggcgcggacggctcgctgctcttccccgacgacatcctcgccttcgctgctctgctcgtctcgctgcctctgccatacatagcggtcaccactggcttcaccggccatggcaccaccagggcagcacaagacgctgagcccgagcacaacgtcccggaggcgcctccctcctcgccgtacgccgccgcttcgttcctctcgcgggcgacgttcagctggatcaactctctcatcaacaagggctacgcagcagaatccttaaaaaccgaagacgtgcctccggtctctgccggccaccgcgccgaggcagcgcacgcgctgttcatgtcgaattggccggcgacgtcgccggcgtctcggcacccggtcggcgtggcactctggctgtctttctggccgcagctcgtgctgactgcgtttcttggcctcgcgcgcctgggtgccatgtacgtcggcccatcactcatcgaccggttcgtcgagttcatccgccgcggcgggacaccatgggagggtctccggctcgttctcatcctgctcgccggcaaggccgtccagacgctggcctcgcaccattacagcttccagggccagcttctgggcatgcgcatccgcggcgcgctgcagacggcgctgtaccgcaagtcgctgcggctcaccgccggtgcccggcgagcgcacggcgccggcgccatcgtgaactacatgcaggtggacgctgggatcgtgtcctacgccatgcacgggctccacgggctgtggctgatgccgctgcagatagtggtggcgttgctcctcctgtacgcctacctcggccccgccgtgctcatgacgctcgccgtgatcaccgcggtgaccgtggtcaccgcgttcgcgaacaagctcaacctggcgtatcagctcaagttccttggcgtccgcgacaggcgtgtgaaggccatcaccgagatgctcagtaacatgcgtgtcatcaagctgcaggcatgggaggacaccttcggcggcaaggttcgtgacatccggcgagaggagcttgggtggctggcgaagaccatgctcttcatgtgtgccaacacgctggtgttctcgagcggtccgctcgccatgacggtgctcgtgttcgggacctacctcgccgccggtgggcagctcgacgccggcaaggtgttcacggccacggcgttcttcggcatgctggaaagtcccatgcggaacttcccgcagacgattgtcatgtccatgcaggcgtttgtgtcgctggataggctgaacaagttcctgaccgacgccgagatcgacgccgcggccgtggagcgcatcgagagcggcggcgctgaggacacggtggccgtcaaggtggaaggcggggtgttcgcttgggatgtgccagccggcggggagatgaagggcaacagcgacaggaggtccagccatgccgtggcagagaatggccaaggaaacggagcggagttggtgacggtgctgaggggcattgatgtggtggtgaggaggggtgagcttacggcggtggtcgggaaagtgggctccggcaagtcgtcgctgctgtcctgcttcatgggtgagatgcacaagctctccggcaaggttagcatatgtggaagcacagcatatgtttctcagacctcttggatccgaaatggaaccattcaagagaacattttatttggaaagccaatgcgtccggagagatattcagaaatcataaatgcttgctgcctagaaaaggatttggaaatgatggagtttggtgaccagactgaaataggtgagcgagggatcaatctcagtggaggccagaaacagcgcatccagcttgcaagagcagtttatcaagactgtgatatatatcttcttgatgacatatttagcgcagttgatgctcatactggatcagctattttcatggaatgtctgaagggtatactcaagaataagaccgtgttgcttgttactcaccaagtggacttcttgcaaaatgtggatactataattgtaatgaatgatgggttagtcatccagtcagggatctatcgtgagttactagcatcatgctcagaattttcggatcttgttgctgctcatcatagttcaatggagacagcagggggacaatgttttcatgttcagaacacagagagccctcaggcttccaatggatctgtagattccccatctttggcatcgaaatccaatgctgaaaatggtgaatcggttggcactgcaacaaacaaagaagcaggttcttctaagctgatccaggaagaggaaaaagagagtggccgagtaagctggcgtgtttacaagctatatatgacagaggcctggggatggtggggagttgtgatcattttagctgtgtcactgctgtcagagggctccagtatggctagtgactactggttatcatacgagacatcaggaggccctgtgtttgacacttccatatttcttggtgtttatgtttcgatagttgctacgacaattatattggaaatggtcgccactcttattgtgacattcttggggcttcaatcagcacaggcctttttcaacaagatgtttgacagcattctacgagcaccaatgtcattttttgacaccactccttcaggaaggatcctaagccgggcatcatcggaccaatctaagattgatactaatcttgtgttctatgttggttttgccacatccatgtgcatttcagtggttaccaacattgctattacttgccaagttgcatggccgtcagtaattgcagtacttcctctactgcttttgaacatctggtaccggaatcgttatattgcgacatctcgagagctttctcgtcttcaaggagtaacaagggcgccaattattgatcactttacagaaacctttttgggtgccccaactgtaaggtgcttcagaaaggaggatgagttctaccagacaaacctggacaggatcaattcgaatttacgaatgtcatttcataattgtgcagctaatgagtggcttggatttcgcctggagctaattggcacacttattttgtctataactgcttttctcatgatcagcttgcctagcaatttcatcaagaaagaatttgtcggcatgtccctttcctatggtctttctctcaattccttggtgtactacgcaatttccataagctgtatgatcgaaaatgatatggtagccttagagagggtgcatcagtacagtactctcccttctgaggcagcatgggaagttgccgactgtcttcccacaccagattggcccatccgaggagatatcgatgtgaaagatctgaaggttcgatatcgtcaaaacacaccactaatcttgaaaggtattactgttagtattaagagtggagaaaagattggagttgtgggaaggactggcagtggaaagtcgactttagtgcaggctttattcaggattttggagcctgcagaaggccatatcatcatcgatggtgtcaatatctgcactttggggcttcgtgatctgaggtctcgctttggtgtgattcctcaagagcctgtgctctttgaaggaactgtaaggagcaacatagacccaacagggcggtattccgaagccgagatatggcaggcccttgagcgttgccagctaaaggatatagtagcctcaaaaccagagaagcttgatgcactagtcgccgacatgggggagaactggagtgtagggcagaagcagctcctttgcttcggccgagttatactgaaacgcagccggatcctcttcatggacgaggcgacagcttctgttgattctcaaacagatgcggccatccagaagatcatccgtgaggaattcaccgaatgtaccatcatcagcattgcacatcggataccgactgttatggacagcgatcgagttctggtgttggactcaggtctcgtggcagaattcgatgcaccctccaaattgatggggaggccatcactctttggtgcgatggttcaggagtatgcaagtcgctcttctagcttgaaggaaaccgttggatgagaccacatttcatggcaaaagacgacgacagtataggagaaagtttaggcatacgcataggcatacgcatagcatctaacgaaaacgaaaaataaattataggagtttctgtaagctttattcgctacaacatgtcttatcttcaatagaactggactatttggtttacatttccaccaattttgtatgtgatgaaagcttagagcaactacaggaagtttgtgtaatttacttgctaaaccaacgactttatcaagttaagaaaataagtagcaatataaattta

SEQ ID NO: 104 - DNA, 1090 bp, Sorghum bicolor
gggagccccggccccaaaccaaaaccaggaaaaccacgctacaccagcacttttcgccgtcgctgcgtcctgcctaccagtgactcgcaaggttcgtctccatcgacaatgtgtggcggagccatcatcgccgacttcgtccccgccggcggccgtcgccaggcaaccgacgacaccatctccgcctcctccctcctctccggcgaggaccagcatctggaggagctcggcagcagggtgccggcgccggggcgcaagacggcgtaccgcgggatccggcgccgtccctggggccggtgggcggcggagatccgcgacccgcggaagggcgcgcgcgtctggctcggcacctacgccaccccggaggacgccgcgcgcgcctacgacgccgcggcgcgcgagatccgcggggccaaggccaagctcaacttcccgcccgccgtcggcgctggcgccggcgccggcgcgcgcgagccggcggccaagaggcgccggacgtcgtcgtccgcggcggccgaggagagctcgggctcgtctccggcagcgacgacgaccgtcgtggcgggcgtcggaggcggcggaggaggagaggagacgctgcgtgactgcatgtccgggctggaggccttcctggggctgcaggaggaagcggccgacgagggtggcgacgccgaggcgtgggacgccgtcgacctcatgttcgcgtagctaggcaggccgtcgtcgtactagtactaggggcgctcaggctcagcgcgcgcgtgccgtcgctgtgaacggccgcagctgcagcctgcaggccgcctgcacctgctgttttggatccagtaatatttattataatgtttcttcaagcggttaagctaatttcgagccttgctgctgggtggtgttaagctattactactagtcctgatgatatgcatgtagtagcaggataggtttatttatctggcttgttgataaaaaaaaattaaaccagagtgattataggagctcccttctccgctaattgcccccgtaagcgatagcctatttctagtagaacgtgcagtgttacgtgcaacatgtatcaaggccttgtttagtt

SEQ ID NO: 105 - DNA, 683 bp, Sorghum bicolor
tcatatccatagccacccaccagaaactaaacttgcattgatcgctcatcagttgttctgatcatcagttgatctttctagtagatcgatcggcaatggctgatgaggagaagaagcaccaccaccacctgttccaccgccacaagcaggacggcgaggaggaggcgagcaccggcgaggtggactacgagaagaaggagaagcaccacaagcacctggagcagctcggcgggctcggcgccatcgccgccggcgcatacgctattcacgagaagcacaaggcgaagaaggagcccgagagcgcgcacgggcacaaggtgaaggaggaggtggcggcggtggcggccctgggcgcggccgggttcgcgttccacgagcaccaccagaagaaggacgccaagaagcagggccagagctgagctaggcaacctctcgatcctgcagtgatatagtatatcgtcgcgtctgtcgcttatatattgtggcgtttaatacttataaattgcgtcgtctttgttgattgccagtgattacttagacatgcatgtccgtgtgtcagggcacgaactggcactagtagtttcctgcgtgccaggccgtattattgactattgtgcccgatctgtatctcagtgtttttccccaccaaaatattgaagcatctgtttactgatccgctgcac

SEQ ID NO: 106 - DNA, 1665 bp, Sorghum bicolor
ttcattgcgaagagccgaagacagcaaacaatggggagcacgagcaccaccaccacctcatcttcctcctctgctacccgcggcggcggcgcacacgtgctgctcctgccgtacccaggcgcgcagggccacacgaacccgctgctcgagttcggccgccgcctcgcctaccacggcttccaccccacgctcgtcacttcccggtacgtgctctccaccaccccgccaccaggtgagcccttcagggtggccgccatctccgacggcttcgacgacggcggcgcggccgcgtgctccgacgttgaagtgtactggcgccagctcgaggccgtcggctcggagacgctggcggagctgatccgctccgaggctgccgagggtcgccccgtgcgcgtgctggtctacgacccgcacctgccgtgggcgcggcgcgtggcgaaggcggctggggtgccgaccgcggcgttcctgtcgcagccttgcgccgtcgacgtcgtctacggggaggtgtgggcggggcggctgccactgccggtggtggacgggaaagagctgtttgcgcgcgggttgctgggtgtggagctcgggcccgacgaggtgccgccgttcgcggcgaagccggactggtgccctgtgttccttgaggcgtgggtgcggcagttcgaggggctggaggacgccgacgacgtgctcgtcaactcattccacgagatcgaacccaaggaggcagattatatggcactaacgtggcgtgcaaagacaataggcccaaccttgccatcattttatcttgatgatgaccgcttgccgttgaacaagagttacggtttcaacctcttcaacagcagcgagtcttgtctggattggcttgacaagcagcttccatgttctgtagttcttgtatcctatggtactgtctctgattatgatgaagcacagttagaagagctgggcaatggattgtacaattctggcaaaccattcatttgggttgtgaggtcaaacgaagaacacaaattgtccaatgaacttcgtgccaagtgcaaggaacgtggccttatcgtttcttggtgctcccagctcgaagttctagcacataaagccacaggttgtttcttcacacattgcggatggaactcgacgctggaagcagtagttaatggtgtgccaatggtggcaataccacactgggcagaccagccgaccatatcaaaatatatggagagcatatggggattgggtgtccgggtgcgcaaggatgagaaaggcttggtgacgagagacgaggtggaaaggtgcatcaaggatgttatggatggggatagaaaggataattataggatgaacgccactatgtggatgcaaaaggccaaggaagccatgcagaatggagggagctcggacaagaatgtttgtgaattcgtggcgaagtattcatcaaattagttttcaaagttaatgcattagttacttaattcctatatctttgtggattgtatgtgttactgtatattacattatgtctggggttataggtgctactttgtgatacatacatagaaaatgcttctgtgctctagtgcaataatgaaatagggatcttccatatacaaaaatatataaactattatgcagcatttgaaacgttgtaagggcataattttt

SEQ ID NO: 107 - DNA, 834 bp, Sorghum bicolor
ctttcagcttgcgtgccaaagtctacggcccgtgctccgcgcaccgcccgccctagcgtacgtagtggctataaaagaagcggggcgcagctcaagccagctcgcaagtcacggagagcgtgcagcagaacagagcagagctacttcaggcagcttacaaggagaaagacaacttgctaagagattgcgatggcgtccatgatgatgggaggagacttggtggaggcgtacgtgctcaagaacgcgtacaaggagaaactccggcgcatggaggccgccgaggagacgaagaagggcaagctgggccccgtggcggagaagaaggtctcgggcggcggaagcaggggaggaggaggcctgtttgggctccttaagaagaaggtgcacccaaaagcggcggccgcgtctcccatggagaccaccagcgctgaagaagcaacctcttcttgattcagctctgtgtccgtccaacaaattcgcacgaggcctgcttttttcttcttctcgatcacacgaggcctgcctgcaattacgcaagtagaggattttgtgtagtcttcattctttaattcttcctttgttgacgatccggcgtgttaatactcgcttggcctcatgttgttttcattggttactcggtgtaattgtaaattatattacgtgaaatggcaagacggcattggcgaagcgcccaagccataatatataaatatgtaattaactaaagctggaatattgttttccctatatgtaatgcgatacgcggaactgctagcgcccggacgtccggcgctaacaacgcgtccggacgccgagcccccccacccgcgccac

SEQ ID NO: 108 - DNA, 777 bp, Sorghum bicolor
aagcaagcctgctgggcgccagggatacttcatggactatggcaaaccgctcgtgaagagtgagctcaggctctccctgaatcctcctccttgcgcccaagacaacaaccccaccactcccaccggagccgcctccgatggctcgtcgtcgccatcctgcgcgtcggccgtcgtcgccctgtccttcctcgggctcaacagcgtcgtagccatctaccgctcgagacacgacccccggtccatactgtttgtcaccgtctgcttcttctgcgtcgtccttctcttccacctgcttcgtgtgttcgagagactgccgccgggatcgcccaggaggttgccggtgaaggcggccgtatgggccttgacgaccaccctgacggtgatgttctccggcagagttgccccgttgatgcctgcgcctgtcgccgccgtcgtgtggtcgatggccgcggtgaccatcctcgcgggcttctacttgttcttcgtgtgcccggacgccgcctccaccgccgccgacgagaaaccggcctgcaaggttgccgaaggcccgtgaattgtttatgtatgtgcttttgtatttgttattattacaaatatcttgtaaggaacatatcataccaacggcataatcggagctggttcgctatattaggcattgctcgaacggccaaaacacgctcgcaggttcgcacgtcctcagacgtttccgcgactatcctcgaactttctctcctcctgtataagtatcagactatgatcgatgattcatttcatttt

SEQ ID NO: 109 - DNA, 1351 bp, Triticum aestivum
aaaacggaagaacagctacgtaagtccttatgtcactccggccagtataaaagccggtggctcgtcctgtacttgaaccacaagacaagacaagctcaatcactctgcagagacggcgcatggcctcgacaacggcggtgccggaggtggcgctgcggtccggcgacgcgaggcccatgccggccatcggcatgggcaccgccaagttaccggtggtgccggagaccacggtgaaggccgtgctggaggccgtggtggtgggctaccgccacttcgacacggcctccatgtacgcgacggagcggcccctgggcgaggccctcgcggaggcggtgcgccgcgggctcctggcgtcccgggaggaggtgttcgtcacgtccaagctctggtgcacgcagtgccacccgcacctcgtgctcccgtccctccgggagagcctccagaacctgcagatggagtacgtggacctgtacctgatccactggccgataagcctgaagcccgggccggcggttttcccggtgaagcgggaggacgccgtcccgttcgacttcgcgggcgtgtggcgcgcgatggaggagtgccaccgcctcgggctcgccaaggccatcggcgtcagcaacttcaccaccagccacctccacaagctcctcgccgctgccaccgtccctcctgcagtcaaccaggtggagatgaacccggtctggcagcagaggaagctgagggagtactgcgccgagaagggcatccacgtcgcggcctactcgccgttgggagggcagaactggtccggcgacggcaacgccgtcctggactccgaggtgctcgcggagatcgccaaggctagaggaaagaccgttgcacaggtagcactgaggtggatttacgagcaaggggcgaccccgatcgtcaagagcttcagcaaggagaggctcaaggagaacctcgggatcttcgactgggggctcaccgacgacgacctgcgcaagatcggccagattccgcagaagaagatcgtcagagctgaaaccgtgctgttctcggcggagggcgagttcacgtcggctgacctcgcggagatggaaattgtcgaggaataatataggcaccgagaatgccttcttcgctgtgtgacgtaaactgcagtagcttgcataaagagtggggatgaataaagaagtgatccgtgctgtatcctgttattcctcttttcggattcaagttgtcagtgaagactgtgatcaccgttgccatccgctcggaagtattccctaatttgaactgcaaaaacggcttatattagtgtactactccctccatttcaaaataaatgactagtacaaagttggat

SEQ ID NO: 110 - DNA, 538 bp, Triticum aestivum
tcagggaaggaagagaagagactgcttggtgaagtcgctggtttcgtgtgatcaagagctcgggtatggagttggagatggtgagccagcacggggcgctgctgaaggtggggctgttcgtgctggtgcaggcgctggtgtacctcatcctcgcccagtcctcctccgtcttctccaccaccaagaccctctgcctccccccggcgcgctccctcagcgcccgccgcatggtcgcgctgctctccgacctgccgctgccgctcggcggcgagccctcgccccgcgccgtcttcgtggagccgtcgtcgcccgtgcccctcgcccaccagaagaaggattagttattaaccaagcgcgactggcggcagggacacggaccgagctagcaagcgatcgtttccgagctactagtagtagtactcggtgcgtgctgtaggagctattcacgccattctttcattgattggttattggtttgttctttgggattggatatgtaaactgagctacacgccgtttgggtttgtacaatcaagtg

SEQ ID NO: 111 - DNA, 810 bp, Triticum aestivum
ttgccgttaaatagacccatctctgcaccattggagagcaagcagcacaaaccagagctcctcacgaagagctaagcaatcgcatcgcatcagatcaccaacatccattcctagcttactagctagctgatcccaatggcgagcagcaccgctctctcctgcctggccgcgctcctgctcctcgcggccgccgcggcgccggcgtcggcggcggagaaggagacccggctgcgggtgtactggcacgacgtcgtgagcggcgggccgaacgcgagggtggtgcaggtggcgcaggcgccgtcctccaacgcctccgccacgggcttcggcaccgtgctcgtcatcgacgacccgctcaccgaggggcccaacctgacgtcgaggctcctcggccgcgcgcaaggcatgtacatcagcgccggcaaggacagcctgtcgctgctcatggccatgaacttcgtcttcgtcgacggcgcctacaacgggagcagcatcgccatcatcgggcccaatcaggcggaccgggccgtcagggagatgcccgtcgtcggcggcaccggcgtctttcggttcgcgcgcggctactgccagttgcggacccactggttcgacgccaagaccggcgacgccaccgtcgagtacaagatccatctccgccacgactgatgcattgtcagctggactaataataaacttgttgttcctacacatatggtttcctgatttgaaccaagcttattttaaatttcgagggtatgtgcatgtgtcgtacggatgtgattatttggaataatacgattttaataaaca

SEQ ID NO: 112 - DNA, 1082 bp, Triticum aestivum
cttccgatctctttgcgagctctaaatcgtcgcattcatggcgatgatggcaacgggcacgaacacgtccacggaacatcatcttctccgcagccaggctgccatgacaatgcagaaaggaagcggcgtgttgacccccgccagcgttgcatcagccatgacaataccccatctgcacacttttcctcaagaaggtgcccgcatgcataaataaagccagacgaggcgtaccatcaagcagccaagaaacgaagctgctaggtgctcggcgcacacatgtcgtcatcctcctctgccccagcggccgccgtgccgacgtcgacccgcctcatcctggtgcacggcacgggccacggcgggtggtgctggtacaaggtggccaccctcctccgcgccgcggggcaccgcgtcgacgcgccggacctcgcggcatgcggctccgacgcgcgccggctgagcgacgcgcccaccttcgaggactacacgcgccccctgctcgacgcgctccgggacctcccggacggcgagcgggcggtgctcgtgggccacagcttcggcggcatgagcatcgcgctcgccgccgaggagttccccgacaaggtcgcggccgccgtgttcctcaccgccttcatgcccgactgcgacggcccgcgcacccgcgtcatcgaggaggttcccgtgtccgactggatggacagcgtggtcgacgaggagcacgccccgccgtcggtgttcctcggccccgagttcgtgcgccggaagctctaccagctgacttccgaggaggactacacgctgtgccagagcctggcgcgggtgagctcctactacgtggccgacaacaacaacaagggggggttcaccgccgcccggtatggcgcggtgaccaaggtctacgtgatcgccaagcaggacctggccatggtcgaggagtaccagaggcagatgatcgcaggcatccccgtggctgaggtgagggagatggctgatgccgaccacatggccatgctctccgcgccggaggaactggcgggccacctcgccgacatcgccaacaactacacttaatcgagttgcggagc

SEQ ID NO: 113 - DNA, 854 bp, Triticum aestivum
caccaacgaacttcaaaaactattctcaacacttgtgcacacgcaaagattccatgggagcgaagctttcctgcttttccaaccacggaggcagcctctcgcagcagccacaccagccggcgcctgtcagggtcgttgccgccgacggatcgctgaaggagctcccggccagcccacgcgtcaccgtctccgacgtgctcggcggcagcgccgcgtccttcttcgtgtgcagctccgacgcgctctacttcgagcagagccctccggcgctggcatccggggaggtactccagtcggggcagatatacttcgtgctcccggcggcgttgctcgggcggccgctatccagcgccgagatggcctcgcttgcggtgcgagcgagctcggcgatcgcggccaagaagccgcagcggaggcgggggcgcctcagcggcgggaggaagaaggtgcgcgtcatgccgatgcacgaggaggtggaagacggcgaggatgttctgctgaacgagaagcttaacgagcggacgctcggggagttcgccgtgtcgccgatgagcccagagaagatcggcgtggtggcggcacggtcgcggctgaagatgaagctgaagcgcgctctgagtatcattcaagaggttgctgagtgaagcatttctctaaaagataaatactagtggtgtttttttttagtttttggttctgtttgaagccatatttaggtttaagcccaaatatttaattggtttagttgatttaggataggaagaacatgtattctgggaaagggtatgtgaatatgtcccatggtgtatgtgattcactatagaatacttatatgcaagactaaaagaatgcaa

SEQ ID NO: 114 - DNA, 1817 bp, Triticum aestivum
ttccctctccaatcccccttgtccgtgtgatttaggagcaccgcagaaacaacaatggagatgggtagcttccccttcttctacgtcgccgccatcacctttctcaccgcccttttgctccgctccttcctcaccaagaagcggcgacggctgccacccggcccggcgctggcggtcccgttccttggccacctccccttcctcaagaagccgctgcacgccacgctcgcgcgcctcgccgcgcgccacggcccggtcttctccctccgcctcggctcgcgccccgccgtcgtcgtcacctcggcggagctcgccagggagtgcttctcctccgacctcgacgccacgctcgccaaccgcccgcacttcccgtccgtgcgggaggtctccttcgactacaccgtgctcaccctcgccaactacggcgcccactggcgcgccgcgcgccgcgtcgccgtcgtgcacctcctctccgcgcgccgcgtcgacctcatgtacgacgccgtcgtcgcccgcgagctgcgcgccctggtgcgccgcctcgcgcgccttaccgccggcggtgccgcggccagggtggagctgaagcggcggctgttcgacctctcccacagcgtcctcatggaggccctcgcgcggagcaggaacacctactccgacgacggagcggacatgtcgcaggaggcgcgggagatgaaggacgttgtggacgccatcgtgccgctcgtcggtgtcgccaacctgtgggactacctaccggtgctacgctggttcgactggcgaggcgtcgggcggcagctggcggacgtaacgagccggaggaacgccttcatatacaagctcatcgacagggagaggcggaagcagcaggccgccgccgacgagcatgaggaggagcagggcatgatcggcgtcatgctctcgctgcagaagtcagagcccgacctgtacacggacactttcatcgccgccctcgtcgccaatcttcttggcgtcgggacagagacgacgtcgacgacgacggaatgggcgatggcgctcctgctgaaccacccggcggtgctaaagaaggcacaggaagagatcgacgcgcacctcagcggcgagccgagccgcctcctcgacaagaaggacctgccccaccttccttacctccactgcatcatcaatgagacgatgcggctgtgcccggccgcgccgctgctgctaccacacgaggccgccgccgactgccagctccacgggtacgacgtcgccgcgggcaccatcgtgctcgtcaacgcgtacgccatccaccgcgacccggctgagtggggaccggcgcccgaggagttcaggccggagaggttcgagcatggcggcgccgaggggaagctcatgatgtccttcgggatgggaaggcgcaagtgccccggggagagcctcgccatgaggaccatgggtatggttcttggcacgctcatccagtgcttcgattggaaaagggtcggggatgaagaggtcgacatggccgccagttccgggatcgtcatgttcaaggccgtcgctctggaagctctctgcacaccgcgagccggcatggaaactcttcttcacaagctctaaactgaaaatggttaaaggaagcagaaaataattggaacaaaagagtacacacactagtagaaatataaataactatagtgtaattaagtctttattaactccacagtatgtacacattgcatagtttgtactacctttcacagtaatgttcttgtgaatatatcttcgcagatgcacattgtataacatccctaaattatttcacaattttt

SEQ ID NO: 115 - DNA, 455 bp, Triticum aestivum
gttcctcggttcctaagtcagcagggtttgttcatcgacggtcgttcctttcgtcgtcgccggcatgcagcggagcagctcgttcgggacgtcgtgggcggaccagtgggacaccggcgccgacccgagcccgcgggcgcgcggcggcggcaacggtggcggcgacggcaagaagggcggcgtggagaagaccaaggcggccgcggccaccgggctgaagaaggtcaaggccggcaccgcgcaggggttccagtggatcaaggacaagtaccagaagaagagcgccggcaagagcggcaagcagggcggcggctccgaggtggccgccgggtactgaccggtcatctgagacgtttggatatgtatggaatcgtcatggaccgatgatgttcttatagtttataagttttagaactttttctaatcccaactaaaaagtctctagtgcttaaaaa

SEQ ID NO: 116 - DNA, 1185 bp, Triticum aestivum
ctttgaacatcttccttgtgcaaaccagttcattccgcgacggtgttctgcttctacgtgctgtaagaagcaagcaagcaagcaactaggagctaaccagccagtcaggtgaagagagcatggcaagctaccaccgggtccacccggtgatcgtcgacggcgcgccgcccccggtgccggagcaaaacaaggacaagctgccaccgccacccagcggcgcctatggcgaccggctgccgatcaccgcccctgcgccgggcgcgccggcgcctctgaaggcaccgcggcggaagcggcacagcaggtgctgccggtgcgtgtgctgcacgctgctggtgctgatcgtgctcgtcgtcgcgctcggcgccacggcggggatcctctacgccgtgttccgccccaagatccccacgttccgcgtggagcggctcacggccacccggttcgacgtgaacaccacctccatgacggtgaccgacgcgttcgaggtgcaggtgataacggacaaccccaaccggcgcatcggggtgtactacgacggcggctgggtcgccgcctccttcaacggcaccgagctgtgccgcggcgccttcccggcgctctaccagggccaccgcagcacggtgcggccgctcatcacgctccagggggagaccaggctcgacagcgccgtggccgcgcagctggcgcagcagcggcaggccgggttcgtgccgctcacggtcaccgcgcgcgtgcccatccgcatcaagtttggcgccctcaagctgtggacgatgacggggaaggcgcggtgtagcctggtggtggacagcctcgaggccggcacgcggctccgcatccgctccaacagctgcaccttcaagctcaagcctaattagatcattctcaaaccgtttgagccgtgcacggattgtgcatatatacgtgtgtcttgtatgtaggattaccgaggtctcgtccccgttcctgtcgatctatattgattgagatcgatcggcagatggtagagatgggtagtgctgtaaatttattatttatttttggctcgcatattcattatttttagtgtaataaataagatccgaggtgtattcatttgctatgaatttctctggagacgataataaagagaagatattggctcatgcacacagtcttgtgtgtgtggttttcaggcttatg

SEQ ID NO: 117 - DNA, 1934 bp, Triticum aestivum
tgcaccgcttccaagtcctcccagcttgacaaactccactagcacttttgctgccacagccgatcagccatgaccctctccggcagcggcgatagccagagcggctccgcgagggcgcacttcgtgctggtaccgatgatggctcagggccacaccatccccatgaccgacatggcacgcctgctggcagagcatggcgcgcaggtcagcttcatcaccacgccggtaaacgccgctaggttggagggcttcgccgctgacgtgaaggcggcaggcctggctgttcagctcgtggagctccacttcccggctgcagagttcggcctaccggatggatgcgagaacctcgacatgatccaatcaaagaatttgttcctgaacttcatggaggcctgtgctgcgcttcaggagccgctcatggcgtacctccgtgagcagcagcgctcgcctcctagctgcatcatatctgacatgatgcactggtggaccggcgacattgcaagggagctcggcatcccgaggctcacctttagtggcttttgtggcttctcgtcccttgtcaggtacatcatttttcacaacaatgtattggagcatatcacagatgacaatgagctcatcacgatcccagggtttcctacaccgctagagatgatgaaggctaaattacctggaaccctttctgttccgggtatggagcaaattcgtgagaagatgtttgaagaggagctgagatgcgatggtgagatcactaatagcttcaaagagctcgagacattttacattgaatcctttgagcagataacaaggaagaaggtctggacggtcgggccaatgtgcctgtgccaccgaaacaggaacacaatggccgctaggggtaacaaggcggcaatggacgatgcacagtgcttgcaatggcttgattcaaggaagccaggctcagtgatctttgtaagctttggcagcctcgcttgcactacacctcaacaacttgttgagctgggactgggactcgaagcctccaagaaaccgtttatttgggtgatcaaagcaggacctaagtttccagaagttgaggaatggctcgcagatgggttcgaggagcgtgtcaaagatagaggtatgatcataaggggctgggcgccacaggtgatgatcctgtggcaccaagccattggaggatttgtgacgcactgtgggtggaactcaataatagagggcatctgtgcaggtgtgcccatgatcacttggccgcactttgcagagcagtttttgaatgagaagctggtggtggatgtgctgaaaatcggggtggaggttggcgtgaaaggagttacacagtggggaagtgaaaaacaagaggttatggttacacgagatgccgtggagacggcagtgaacaccctgatggacgagggggaggctgcagaggagctgagggtgagagcaaaagactgcgccattaaggcgaggagggcttttgataaggaaggctcttcctataacaacgtaaggctgttaattcaagaaatgggaaacaagacgaatgcatgtggttgatacagacggtaataagctcgccttttctgtgtaaacatgaagtgaaagatcctagaagacatatatcatcatatagaattttgtaccaggctcacaggtgattatttggagattagagatgatccaaatgaaggcaatatcaattgtcttcttttgtacgctcttttatggcaatccaccacataacgactacacagtctgctcttctagatggttacgctctcacttgcattttgctaccgctgttgcacaactagccatggttgtcaaagcataggacaatgccgtgacgccaagcagctcaaggaagaagtgtgccctgggagcaactggggagggggcgtcgccgtgccctcgacagtgttctgttgcat

SEQ ID NO: 118 - DNA, 594 bp, Triticum aestivum
cacaactacacgagtcccaaaccatctgcaagcatcgttcatcctagccaggctcctaacttacttgtaccttacttagacaaggaagcaacggcagcagcaagaatagttgaggagaaggagaggaggagctgataaggcatggcgtccatgatgggaggagacttcgtggaggcctacgtgctcaggaacgcctacaaggagaagctgaggcgcatggaccaagccgaagctgcggcggcgcaaagagcaccaaggacgccgccggtgccgctggagagaagaagaaggctgctgctggcggcggtggtggtgcgagcagcaggggaggcttctttggcctcgtgaagaagaaggtgcaccccaaacccaaagcagcagccgcggccacttcctcttgattatactactgtattcgccatgccaccaagttgtaagccgcagctttcttctagctaggagcgtatgtgtgtgtatgtttgttctttcgattagcttctctgaggccaaagaaactttgtgttggaggagtgtgtaagtcactggctgtaatgtttgcaagttgttttgttcattggttcaaataaagttgac

SEQ ID NO: 119 - DNA, 525 bp, Triticum aestivum
tagctgcccagctctcaaagcctcgctcgaatcattagctagcagcatcgaatcatcagcatggcttctgccggccgtcgtcccacggtgctccagcagatcgctctcttcgtcgtcgtcgccgcggtgatcatgaacagctccgtctgccttggagccgctggccacgacgccactgtagtaggcactggtagcaacgaccctaaccaccctgcttttccgtcgccgcctggtaaaccctacaccggtcgtccgtgcatccctaagtaccgctgctacccaccggctggtggccaaccctaagtaagaagtaagatgcacccgcccgcgccgagaccccgtcccccaaaaaataatgcaaggatcgatcgatatatatgtatatactatatgcatgcatgcacgcatgcctccgacgtgtctatgcgagttattctattgccatgcatcaccttatactcctacacagtaatattgtttcctgtactatttacactctgaataaaactggatatatattgctgc

SEQ ID NO: 120 - DNA, 1437 bp, Zea mays
ggggaagtcacactcacacgttcgcgtgttagactctcctgaaaccagcgtgctgtgccgcccgggacgatggcgccgcgccagccgctgctccccagtttcctctacgcggcgtcgtccggcgtcaacggcagcagggaggcgcctccggtggtggcgggcgccccgagcgagccgctcggcaagatcgagatgttctcgcccgcatactacgcagcgggcgccttgggaggcgccgcggcctgcgggttcacgcacgccgccgtcacgccgctcgacgtcatcaagtgcaatatccagatcgaccccgccaagtacaagaacacctcgtcggcgttcagcgtggtgatgagggagcagggcctccggggcttcttcagggggtgggcgccgacgttcgtgggctacagcgcgcagggcgcgttcaagtacggcctctacgagttcttcaagaagacgtacgccgacatggccggccccgagcacgccgccaggtacaagaccctcatctacctggcgggctcggccaccgcggaggttttcgccgacgtcgcgctctgccccatggaggccgtcaaggtccgggtgcagacgcagcccggcttcgccagggggctcagcgacggcttccccaagatcgtcagggccgagggctacgcagggctattcagaggactggttcctctttgggggcgacagattccttacaccatgatgaagttcgcgacgtacgagaacatcgtggagatgacctacaagcacctcatccccacgccgaaggaccagtgcagcaagcctctccagctcggggtaagcttcgggagcggctacgtcgccggagttttctgcgccgccgtctcgcaccctgcagacaacttggtgtcgttcctgaacaacgccaagggagccaccgttggagatgctgtcaagaaccttggcctgttgggcctcttcactcgtggcctccctcttcgcatcctaatggtcggcaccctgactggcgctcaatgggtgatctatgattccttcaaagttatgattggactgccaacgactggcggagcgcctgctcctgctactgtcccaatggaaggactcggagagctaaaagcctctgcctgaagttctaaagtttgacagagagtatgcatgcttccgtccatagcgtatactggtgactgtaacagaccctcacccccaccagaaaatattgtctcaagctggtgattttgttttgaataagataagttattactgtatgctacgagtatagaatacgacatgtagaagactataagttactagtcacaaagttgataaatcatttttgggtgaaatttatttgggttcgtactggattgtgttcctccaatataaattgtgttcctccaatataaatgtattcatatcgaactatatatgtatatatgttgcaac

SEQ ID NO: 121 - DNA, 1082 bp, Hordeum vulgare
ccaccatggcgagcagcggcagcctggccggtctggcggtgctgctcaccgccgtgctgtgcctgcagctgccggtccacagccgcgcccagctgcgcgtcgggttctacaacaccacctgccccaacgccgaggccatcgtccggcaggccgtcaccgccgccttcgccaccaactccggcgtcgccgccggcctcatccgcctccacttccacgactgcttcgtcgagggctgtgattcatcggtgctcctgtccgtcaaccccggcggaggcacgacggagcgtgacgcggcgccgaacaacccgagcttgcgtggcttcgaggtcgtgaacgccgccagggccgcattggagcagagctgcccgcgcacggtgtcatgcgccgacatcctggccttcgccgcccgggacagcgtgaacatcaccggcagcaacgccttctaccaggtcccctccggccgccgcgacggtaacctctcgaccgacgccggcgcgttcaccctcccggggccgaacctgacggcggccggcctcgtcacagggttcgagatgaggggcctcaacgcggaggacatggtggtcctgtcgggctcccacaccctgggccgctcccactgcagctccttcatcttcaagaaccgcgagaggctggcgagcggcacgatcagcccggcgtaccaggcgctgctggaggcgctgtgcccggccaacacggggcagttcaccaacgtgacgacggagatcgacctgagcacgccggtggtgctggacaacaactactacaagctggtgcagctcaacctgggcctgcacttctccgacgaccagctcatccgcaacgccaccctcaaggccttcgtcgacgccttcgccgccaacgagacgctgtggaaggacaagttcatcgccgccatgatcaagatgggcaacatcgcgcccaagaccggcacgcagggccagatccgcctcaactgcagcctcgtcaacccgtcctcctcctcttcgtccgcttcttacgctggggcgatcgagatgctccgccgcccgggctcgcacgacaaggtcgccatggcctgatga

SEQ ID NO: 122 - DNA, 902 bp, Hordeum vulgare
agcgcatgcatgcaaacaaatcactagcgagccgcatacatcacatcacaaacgaagcgcggcacgcaatggcgccctcctcgtcgtctccactgccggcgtctccgctgctcgtgctgctgatggtgccgctcctgctcgccatggcgcgtccgtgctccggcgtggacgccatcggcacctactgcgctaagaacggcaccagcgcggagacgcaggccagcatcgaccaggtcctcgcggcgctcgtcccgcgcgcctcggcggcgtactacgccacggccaccgccggccgctcctcgtccgcggtctggggcctcgcgcagtgccgcggcgacgtcccgcgtcaggactgctcgctctgcctcgccgcggcggccaaggaggtcgcgtcgtcctgccgaggcagctcggacgggcgcgtcttctacgactactgcctcctccgctactccaccgccaacttcatcggcctcgctgacacggggtacacgctcatcctcctcaacacccagaacgccaccggcgtcgacctggccgcgttcgaccgggcgcaggggaagctcatgtcccgcgtcgcctccgaggccggcgacgccgccaacaagggcctggcgacggacacgacgcgactcggcagcgatggtggcggagccaagacgaccatctacgggctcgggtggtgcaccagggacatcacggcggccgactgcgggctgtgcgtggcgcaggctgtggccgagctgcccaactactgccggtaccggcgcgggtgccgcgtgatctacagcagctgcatggcgcgctacgaggtgtaccccttcttcttcccgctcgacggcgccgacaagtcggccgacgaggtcggacagtgcgacaagattgtcttgaacgcgtgatag

SEQ ID NO: 123 - DNA, 1436 bp, Hordeum vulgare
gaaacatggagaccacggtcaccgcggtgtcaggcaccacgagctcgagcgtcggccatggagccggcggcggtgctgcgagagtcctcctcctcccgagcccgggagcgcagggccacaccaacccgatgctccagttgggccgccgcctggcgtaccacggcctccgccccacactcgtcgccacccgctacgtgctctccaccaccccggcccccggtgcgcccttcgacgtggccgcgatctccgacggcttcgacgccggtggcatggccttgtgccccgacccggcggagtacttctcccggctggaggccgtgggctccgagacgctgcgggagctcctcctgtcggaggcgcgcgcggggcggcccgtgcgcgtgctggtgtacgacgctcacctggcgtgggcacggcgggtggcacaggcatccggcgtcgcggccgcggccttcttctcccagccgtgctcggtggacgtcgtctacggggagctgtgggcggggcggctggcgctgccggccacggacgggcgcgcgctgctcgcaagaggagtgctgggcgtggagctggggctggaggacatgccgccgttcgcagcggtgccggagtcgcagccggcgttcctccaggtgtcagttgggcagttcgaggggctggactacgccgacgacgtgctcgtcaactcattccgtgacatcgagccaaaggaggtagagtacatggaattaacatggagagcgaagatggttggaccaaccttgccatcatactacctcggcgatggtcgcctaccatctaataaatcatatggtttcgacttgttcaacagcgatgtggagtgtatggattggctagagaagcaaatgaattcatctgttgtgctcgtgtcctatgggactgtctccaattatgatgcaacccagctagaggagcttggcaatggtttgtgcaattctagcaaaccttttctttgggttgtaagatccaatgaggaacacaagttatccgaagaactcaaagaaaaatgtgggaaaattggattaatagtctcatggtgcccccagcttgaggttcttgcacatagggctataggttgcttcgttacccactgtggatggaactcaacactagaggcacttgttaatggtgtcccttttgtgggtattccacattgggcagaccaacccaccattgcaaagtatgtggagagtgcatggggtatgggtgtgcgtgcacggaaaaacaagaatggatgtctaaagaaggaggaggttgagaggtgcattagagaggtgatggatggggagagaaaggatgagtacaaaaaaaatgccatgaactggatgcaaaaggccaaggaggcaatgcaagaaggaggaagttcagacaagcatgtagctgaattcgctaccaagtattcgtcaatataataa

SEQ ID NO: 124 - DNA, 710 bp, Hordeum vulgare
tgtgcatggaaggggcggggagcggctgcaagatgggaggaggagaggggatgtccggccgtgccggtgctggtgccgccgcggcggccaaggagaagtccggcttcgccgccacctgcagcctcctgagccgctacatgaaggagaagaagggcggcgctctgcagggcctcgttggcctcgacatggcgccgccggccgccgtcgtcgtaggaggaggagctttccagccgcccaccaccatgaacctgttgtcggggctggaggagccgaacacagcgggcgtggagctcgcactcgagaaatctagtgttggacagcttctcaaggccccaactgacaaccaagatgcgagagaggatgcgcaccagctcaccatcttctatggaggaaaagtggtcgtggttgacaacttcccatccaccaaggtcaacggattgctccagatggccaacggcgccggcgacgccggagacaaggccgggagcagcagcctcgttcagcagagccctccccagcctgcacacaacactctccctgatctgcctatagcgaggaggaactcactccacaggtttctcgagaaaaggaagggcaggatagtggcgaaggcgccttaccaaattagcagctcatcggcggctccgtccaagcaagctaatggtgacaacgcctggctggggctaggccaggaagtgacaaattgatga

SEQ ID NO: 125 - DNA, 272 bp, Hordeum vulgare
gatccatggccatggagaggttcttcacggggctcgttttctgcgaggccccgcttgacggctacggcacgtccgtgctcaccgccggcgtggtcaagacgctggtgctctctggaggcactgcgacgaagccggcagcggtggctagtagggcggacgccgacaaggaccagggatcttccaacggcaagcggacggcgcaaaggagcgctgggttcgagatcgcgttcgatgggctcaactgcttcgacaccgtcgtcatgcactgatga

SEQ ID NO: 126 - DNA, 944 bp, Hordeum vulgare
cagccatggcggccaaggccacctcatgcttcaccttcctcaaagaagcgctggtcctccccacgcagaaccccaagctcttcgccccaatcttcatcctccttgccgtcatcgccttcctcgtccccgcggtcaacgtggtcttcatccagccgctcaccgccgagatgctccgccacctcgccgagatgcagacaaccgacccctcgaccgccgagttcgccaggctcttgcaggagatacggcaggaaacgagggagctcgtcatcatcaccgtcgccctcacggtcgtcaccctggtgctcgtcttcgccaagcagatcctctccttctccgcggcctgcacgacctactccggcgaccgctacaccctcgcggagctcctccgcaggctgaccaagtggggaaacctgaggggccctctcgtgaccgtgggcgtggtcaccgcgctccagctcacgttcatggtgctcctcggcgtctacctctccagcgtcatgcgccactcggggttgctctccgtgcaaggcgcgctcttcgtcctcgccttcctggccttcatctacttcggggtcgtggccgtggtgggcgtcgccgtgtcggtggccgacgaggggtgccgcggcgtgcgcgcgctcgggcgggcgtggcggctcatgacgcgggtgagcaggaaggagggcgccttgctggcggcggtgatggtcctcctgccgaccgttttgagcccggtgagcgcgctcgcgctcgcgtacgcgaagaagagcatggcggtggggctctgcctgctcgccgtgcaggctctgctgtccggtgcggtggagctgttctacatcgcggcggccacggtgtactactacaaggccatggagagcaagggcgtgatggtcctggcttttgatggctatgccaagataccttcccgtgaggcaaatgtctgatga

SEQ ID NO: 127 - DNA, 1592 bp, Hordeum vulgare
aagcaatgaatcctgaatcggcaatgagtgaactgccatggagttacctcgccttcggcctcttgggcctggtgcttctgtggccagccacccgactactagaccagctgtggtggcggccgaggcggctggagcgtgctcttcgtgccaagggccttcgtgggacgtcgtaccggttcctcactggcgacatgagcgactacggcaggcaaaacaaggaggcatggtccaagcccctgccgctgcgctgtcacgacatcggcgcccatgtcatgcctttcatctacaacaacgtccaggagcacggcaagcagttcatctcctggttcggtccggttccgaaggtgagcatcaccgatcctagcctggtcagggaggtgatgtccaacaagttcgggcacatccagaagatcaagttcccggcgctctccaagctcctcgccgtcggcgtggccaaccacgagggcgagaaatgggtcaagcacagaaggatactcaaccctgcgttccacgtcgagaagctcaagatcatgctgcccgccttttcttcgtgctgtgaagagcttgttaacaaatggacgcagtcccttggtcccgacggatcgtgggaggtggatgtttccttggagctccagagcctcaccggagatgtcatctcacgcaccgcattcggcagcagttatctggaaggaagaaggatttttcagctgcagtctgagcaggttgggcgattcatggcagccattcacaagatcatgattcctggttacatgtccttccctactgaaaataatcgaaggatgcgtcaaattaacaacgagatagagtccattctacgaggtctgatcgggaaaaggatgcaagctatgcaagaaggaggaagcacaaacgatgacttactcggcttattgctggagtcaaacaagacggacgtaaatgaaaatggccaatccattccaggaatgtccgtagaagaggtgatagaggagtgcaagctgttctactttgcaggaatggagacaacatcaatattgctcacatggacgatggtcgtacttagcatgcatccggagtggcaggaccgtgcaagggaggaggttcttggcctatttggagaacataagcttgactacgagggtcttaatcgacttaaaaccgtgacaatgattctttatgaagttctccggttgtacccaccggctagtgcgttcacccgacagacatataaggagattgagatcggaggcgtcacgtacccacccggagtgatttttgagatgtccgtgttgcacatccaccacgacaaggacatctggggagacgatgtgcaccgattcaggcccgataggttcgcaaatgggatctccaaggcatccaaggaaccgggagcatttttcccgttcggatgggggccacgattatgtatcggtcagaattttgcattgctcgaggccaagatggcattgtgcatgattcttcggcgatttgagtttgagctcgcggcgtcgtatacccatgccccacataccgtaatgatgttgcgtcccatgcatggtgctcaaattaagctgcgggcaatctcttcgtagtag

SEQ ID NO: 128 - DNA, 971 bp, Hordeum vulgare
tagccatgggcaccctcgtcggccacgtcgcgccgggcgccggcttcctcctcataggcctgtggcagctgttcaaccacatccggctgttctcgctgcggcccggctcctacgccgcgccggtctggttccccgcgcgcggcgtccgccacctcgagctcatcctcgtcatcgtcggcacgtcgatgtccatcctgatggagctcgtgatcggccccgcgaagcaccagccgttcgacgacgacgggaccatcccgtccgaccacctccacaacttcgagcacgcgtccatctcgctcgccctgctcgcgttcgccgcggtcaccatccacatggacagggtccgggcgccgatgcgggacgccgtgtcgcagctggccgccgccgcggcgttcgcgcagcagctgctcatcttccacctccactccgcggaccacatgggcgtggaggggcagttccactggctgctgcaggccgtcatcgccgtcacgctggtcaccacggtgctgggcatcccgtacccgcggagcttcgtggtgagcctggtcaggtcggcgagcctcgtgttccagggcgtgtggttcatcgtcatgggcgtcatgctctggacgccggggctcatccccaaggggtgcttcctcaaccgcgaggacggccacgacgtggtccggtgccgcaccgacgaggcgctccaccgcgccaagtcgctggtcaacctgcagttcagctggtacctgacgggcaccctggtgttcgtcgtcgcgttctacctgcaggtcagcaggctgtatcccgaagagccgcagtacttgccgctggtcaaggggggacgcgccggcggccggttcagcatcggggacgacgacgatcacgaggacgatgacgacgaggatgatgacatggaggccgcgaagcgtggctacgggcacgtggtcagcggcacaaaacccatggaggtagagaggtagtag

SEQ ID NO: 129 - DNA, 1771 bp, Zea mays
gtttctgggttggatctctcggagtcggagcgagcgaggatgggcggcggcaacggtgaaaccacccagctgggggagccactgctggcgaagaaggcgaaggcgtaccgccctaggtgccccggctgccgggtggaccgcctcaacgcggagcgggagggggtcttccctctcaaggacctcttcctcatctggctcgtcaccatcacctgcaccctgccgatccagtctctgttccccttcttgtatttcatgataagggatctgcatattgctaaacaaacacaagacattggattttatgctggttttgttggcgcttcatatatgtgtgggagggcagtctcctcaacagtatggggaatcgtggctgataagtatggaaggaaaccagttatcgtactaacccttattgcaatagttatcttcaatactatgtttggactaagctcaaactattggatggcattaatcacacgatgcctgcttggaatcatgtgtggttatctcgggccaattaaggcttatgctacagaagtgtgccgaaaagaatacaatcatctggctttggcagttgtttcttcctcacgaggcattggtctcattattggtccagctcttggtggttatcttgcgcagcctgcagataaatatccaagtatattctctcagacgtccatatttgggaggtttccatactttcttccgtgcctgtgtatatcaatccttgcagttattgctctaattgcctgcatctggtttccggaaactttgcataaacacaatggggatgccgttgataattccgttgaaacagtagaagaatctcttgctggcaccgacactgaagaaaatggaggtggcggatgtctaaaattatttacaaactggccgttgatgtcagctattactttatattgtatcttctctcttcaggatgtggcttatgcagagacattctctctttgggctgtcagtgacagatcgtttggtggattaagctttactaccacagatgtgggcaatgtccttgcgatgtcaggtctcttcctttttctatatcaaatgttgatctatccgttccttgccaaaacggtagaccacatcacattagtccgtgcagtggcgttattgactctaccggttcttgctagctacccattctttccttcgttgtccgggttcgggctcatggtggtagtaaattgtgcatcttttctgaagaatacattctcggtaactaccattaccgtgttcaacattttgatgaatgaagctgtgactcaggatgtaagagccgcagccaatgggatagctgtaacactaatgtccatctctaaagcggttgctccagctgttgcaggaatcatattttcgtgggcccagaggcgtcaaacagctgcatttcttccaggcgaccacttggtgttcttcatactgaacatcttcacgttcatcggtttcgtcttcaccttcagaccgtttttcgttcgaggcagtgccaagcactgaaacatggatgaagcggacgacgacccatgggtatcctatccaggggcaatcgaatatagattttcttgtggcgtggccaagggcggtgccgagcctgtaccagtacgacgactcaggccagaacacacggcgtatggtatggtacacagcaaggccgtgttgttgctgtaagttttgtaatttctgtttccttcttctcggcttcgcagcatgcagttgctgtatatgatggaagaacactctgttactgggcatgttg

SEQ ID NO: 130 - DNA, 321 bp, Zea mays
gagacagatacgttcgcagatggcgggtgcagcgaaggcgtcgtggatggtggccatgagcgtgggcgccgtggaggcgctcaaggaccagggtggcctctgccgctggaactacgcgctgcggtccgtccaccgcaccgccaaggccaacgtccgcagcagcctcgccgcgcagcgggacaaggagctggccccggcggcggagtcgaagaggcggccgggcaaggccgccgcggaggaggggatgaggaccgtcatgtacctcagctgctggggacccaactaggaggactagctagggttcactgttcagttcattgc

SEQ ID NO: 131 - DNA, 515 bp, Zea mays
acttgatggacgactgtggcaaacctttcgtgaagagagagctcagactctccctaaatcctgctccttgcggcgacgacaaccccactactcccaccggagccgcctccgatggcggctcgtcagcctgcacctcggccgtcgcgctgttcgttctcgggctcaacagcgcaatagccatctacggctcgagacacgacccccagtccatactgtttgtggccgtcagcttcttctgcgtcgtgcttctcttccacctgctccgtgcgttcgagagaacgcccccgggatcgccccggaggttgcaggtgaaggcggccatatgggtcgtcaccaccgccctgacggtcatgttctccggcagagttgctccgttgatgcctgcgcccgtggccgccgtcgtctggtccatggccgcggtgacgatccttgcgggcttctacatgttcttcgtatgcccggacgccgccgaagagaggccgaccagcaaagttgttgccgaaggcccgtagtaa

SEQ ID NO: 132 - DNA, 1262 bp, Zea mays
ccacacctctgatctgctctgcccatcatccagcgcatccccggccctgacttaacttgctgctcacctcgccatgggaatctcccaccctctctccgacgagtacgacgccctccgcggcgccgtcctctcgccggatacgacgcctccctcatcgccgctcgcccaccgccacctcctggagcacgaggttactaggatggacacgctcgccggcatcgccatcaagtacggcgtcgagatatctgacatcaaaagggcaaacagtttggtaactgacagccagatgtttgcacacaaatcgctgctcatacctctaccaggaatgcccatgccatccctgaatgcttgtggtcaaagaacgataagaacgtgtgctccaaaccatcggcaaaagagagacgcgcccaagtctcgtcagcagggtgcgtcatctgcaatgaataccttgcagagatactatggcctaacaccacctcagaaaggaggaaataccatggatagcagcactgaactgtctgtgtaccataagggcggcggcttccagagtaacctcagcgaaacattgctcaatccttccgcagctccaggcaccgacagcagctggaattttgaagcgctaggcttttcagcgaccgagggcgatggcggggcaccgaaaccagagcaagatggttctatgcggcggcgacagaaagtggaagcagagtctaacgcccagggtgattttctagtgaaggcgatcaagagtctgttgatttccagcgtccgtctagacacgtatgcaggcagcccaggttccagccagaagagcggcttcagatctgtgactgtgaggaagtccccgagcgcgcccagctttgcggatgctgacaatggagtctctatgtggtcaagttccaagtggacgttcagccatgactccttcacccgaccgttgcttgatggcctgcccaaaccagcgtcagctcggaggaccaaccaaaaccgcgttggactgaaactgaactgaatacacacatgtttgagcgtctcctttgatgaacgacgagctgtggcgtgactaggcgactgacttggcagcagagcatatctgtctgcagctctggtgttagcacaattgattggcttgtacaactcctacaaaagagaagagttacgatggagcctagctacatgtaatgtatacaacatgcatacatgcatgtgttgatggaatgaattgtattgtatcccatcccaggcagtgctacacacagata

SEQ ID NO: 133 - DNA, 1847 bp, Zea mays
agctgtatgttcgagcccttcgccgacgacgttcaccaccaggaattttctcagctgtgccaatgatgggttgcttcactgttctcagatccaagaagaagaaaagccattttgataatcctcttgtcccaagcaagaaatcagttgatgcaagggaaagtacgtcctctagacttccggagccagaagttcatgtgccatctttgcaatcagctcctcctagttttaggaacagggtcaagatatccgagtcatcaaatgaagtttcaaacagaaacagcagggctcgcgtgctgtctgctccatcagcccttattgtggttgatcagtttggctttccatattcggaataccgagatcaagatgactccagggataaggaaggtttgacaaaggggcatcgcttttcaaatcctttgccccttcctcttccttcacgcgaaggacattcttttaggaactctggtagcttcaaagccagcaacgtaagcgggccattggagatgtctggccctctcccattgcctctaaagaaatgtgatggacttagaatcttctcttatgaggagatttcatctgcctgccaacgattttctagtgatcagtgtgtttcagaaacacttggttcaacatcatacaaggcaacatttagagatgaatttattgatacgaggaccactgaagcaacagtagctcgattactcccctccactcagagtttgaaggagtttaaaacgcaagcgaccacattggcatcgcttcagcatcccaatttatgtaaactgattggctattatgcaaaagaagattctaatgaaaggatgttggtctatgaacggctttatcatggaagcttagataagctactctttggaagatcagatggtcgtttcatggactggtctaaacgtttgaaggttgccctgggtgctgccagaggtctagctttcttgcatgatgaaggaccctttcaggccatgtacagcgagttctcaactttgaacatccaaatagataaaggtttcactgctaagctttcaggatatggttgtgttggcttcaataccgaggagatatctaatgcacctgtgtctgcagcaaacctttcggtggagaccttggagaagggtttactcactcccaagagcaacgtctggagctttggagtcgtgttactggagctaataactggaaggaagaaccttgatcccaattattccaaagaagaacgcaatattgtcaactggagtaggcctttccttactgatgacagtcgcttgtctcttatcatggactcccgtataaaagggcgctttcccactaaggctgctcggatagtagcagacatcattttgaaatgcctgcgtaaggatccatcggagaggcctaccatgagggatgttgtggaggccctagcaagagtccaggaaataaaggttccgtgcagatatcctctgcaagaaccttctgctgcaccaagaaaagtgatgttgaaatctacatccctcaatgggattgtgcctcaccatcctgtcataaccttctctccatcgccgccttcacataaccagcacttgatttcaccaaggtcgtcgacatctgccttgtttcatccaagggcatgctcttctaccctggacgatccgagtgtaagttctataaagaaaacaccacctattatgcgaaggtctagcgtcgaaggcttttgattgtccatattgttcctttatttccttttcttggatttatttgtttctttgttagtagtgtagcggtttttagctgtgttctgtattgtaagacaagtggcctcatatgtagtgcccttgggtctggagtaaagcaga

SEQ ID NO: 134 - DNA, 1093 bp, Zea mays
agaggcgtctctggttattgctgggagtggacgggccgggaaggagacgagaagataagggcgccgcgcgcggccatggctggaagtgcgccggcgacggcgatggacaagaccagctttgccaccacgtgcagcctgctgagccagtatgtcaaggagaagaagggcggcctgctgcagggtcttggtggcctcgccatggcgccggcagctggagaagaaggagctttccggccgccgaccaccatgaacttgctgtcagcgctcgacgacgcgccggccgaggagcgcagcgagaaggccaccgccggggagccaaaacaccaggacaaatgcaccggcggaaatccaagggaggaggcagccggagaggaggaggaggaggcgcagcagctgaccatcttctacggcggcagagtggtcgtcttcgacatgttcccctccgccaaggtcaaggacctgctgcagatcatgagccctggcggcgacggcgtggacacggcagccggtgccactgtccctacgcggagcctgcataggccttcacacgacagcctctctgatctgccgattgcgaggaggaattcgctccacaggtttcttgagaagagaaaggacaggataactgcaagggcgccataccaacaagtcaacagctctgttgttggcgtcgaggcgtccaaacaggcggctggagctggggtggaaaaaccttggctggggctgggccaagaagcgacaacagcgaagctggagatgtgatgaatgttgcccgacaagaaggtgcagcgcacgagattcacggatggtgcacgtcgtagcttcaggtgaaggtctgaaggataacttaccgtcggttactctactcagtttactgctctactactactgctggtgacgaagttcgcaagaaacgttcttctactacccgtgccggtgggtcggtcagccgttcgttggcgagattgtttgctgctggagtcggacgtgctcgcagcagtttcgctggtccgtgaccgcgccatatgttgccacgaatggttggttgttcggtacgttgaggaacgatgtgtatgtagtgtgcacgtttccg

SEQ ID NO: 135 - DNA, 1180 bp, Zea mays
gaagagaagagaggctaaccaccgcagcggctgcgacctgcgagtgcgacaacctccgcggaggagttggagccggcggcggggatatttgcttgcccggctggggttgcggcggaaggagggagagacaatcggcgatggcggcgtccgcgaggcccggggagagggcgaccagcttcgccgtcgcgtgcagcctcctcagccgctttgtccgccagaacggcgtcgcggctgccgagctaggcctcaggatcaaaggcgaggtcgagcagcagaggacgccggcgacaactagcttgctccccggagcggagggcgaggaggtcgaaaggaggaaggagaccatggagctgttcccgcagagcgtcgggttcagcatcaaggatgctgctgccccccctagggaggagcaaggagataaagagaagcctaagcagctcacaatcttctatggcgggaaggtgctggtatttgacgatttccccgccgacaaggcaaaggatctgatgcagctggccagcaagggcagcccagtggtacagaacgttgttttgcctcaaccctctgcagctgctgctgtcactactgacaaggccgtgctggacccggtcatcagcttggccgctgctgctaagaagcctgctcgcacaaatgcttctgatatgcctattatgaggaaggcttctcttcaccgcttccttgagaagagaaaagatcgcctcaatgcaaagacaccatatcaaactgctccttcagatgccgcaccagtcaagaaggagcctgagagccagccatggctcggattaggaccgaatgccgtggattccagcctgaacctcagctagtacacaacaacacagccataataagacggcacagcaacggcacccaccatgacctggaatttgctttgccactagatcgagttcagaaaccataaatattcttagttatcgtgttttagtgttcgcttatgtcatggttctacgccctcttgtcgcatagttctggatgtaaagaaaagtaaccagtcatgaccatcaccgggagtcggggagaagtttttggagggtgttaacacacggcgactctgaattggccatgctaaggaaaaggatagtgcaatgtgaggtatatgtattttctgaaagccagatcgtttgggtctagccctgatgta

SEQ ID NO: 136 - DNA, 731 bp, Zea mays
catcgatggcgatgagtgacaccggctcgagcttcgcgcagtgggccgcgctctaccaccaccacgaccccgccggcggcccggtcctgcccgacgacgacgcggcggacgctggcaacggcatcggcagcggcaccgccaccgccgcgagcccgacgtcgggagggtccagcggcgggagccccaccaccaaggcagcgtgggggcagcagcatctgcttcacggggtggaggggccccgggtcgccgggaagccggcggcggcgcggcggcggtcccgcgcgtcgcggcgggcgcccgtgacgctgctcaacacggacgccgccaacttccgcgccatggtgcagcagttcacgggcgtccccgcgcccctcgccggcgcgttcagggtcggggacggggccccggtcatcagcttcgccgccgactacggcttcccgcccgcttcttcttcctcggccgtcaacgtgtccttcttcgaccaccagctccaccggagccaacaacaccctgcagcgccgccggtccacaggcagcagcagcagtacgccggcgcgtcgccgttcggcggctacagcagcggcctggtgcaaggcggcggcgcaagcgacgtcttccccgcgtcggcggaggacaggatgctcctgcagagcattctggccgcccagatgccgcacatgccgccggtgtccggcgctaacaccagctctcatggcttctttgcttgatga

SEQ ID NO: 137 - DNA, 1921 bp, Zea mays
acgtactccactccatccatccatcatcgtctatccatgaagagcttgcaggaggagagggcggcgttggtgccgtcgccgtggccccagcaacagagaaaggacggcggcgagcatgatccggagcagctgatggatgaggatgacggtgacgatgaggaggatctgcaggatgagcagcacacaagaacaattaggacgtcgaccaagacggcggaagcatcgtcatcagcggagcggcgggtgccggcgtggtggaggctgcggcgggcgcagaagctgctggtgcccaccagaggtgttggcctggtcatcgccggtctcctcgtgctggtcttgctcctcgtcgtcggcggcggcggcggcgccaacaccagtcgtcgtcgctggatccacctcgactatgcatcgtcgtttctgcgcggcggcggcttgaggcagcatcaatggcctcctcaccacgtcccttcacccgcagccgacctcgtgcccatacccttcagctgcggcggcaacggctcggcatgtccccgtcgtcaaaccgcaacatcacccccctctccgtcgccatcatcgtcatcgccaccagcaggcaccaagtcatcatcgtccaagaataaacaaccccctcctcagtgcccggattacttccgcttcatccactccgacctgtcgccgtggcgcgagacggggatcacgcgcgaggcggtggagcgggggcgccaccgggcggcgttccggctggtggtcgtggacggccgcgcgtacgtggagacgtaccaccgcgtgttccagacgcgtgacaccttcacgcagtggggcatcgcgcagctgctggcgcgctaccccggacgcgtcccggacctggacctcatgttcaactgcgaggacatgcccgaggtcaaggtcaagccgtcggaggagtcgtccgcgccgccgctgttccgctactgcaaggacgactccacggtggacatcgtgttcccggactggtccttctggggctggcccgaggtcaacatccgtccctgggcgccgctgctggaggagatggccgccgagatgggtcgcctgccgtgggcggaccgggagccgtacgcgtactggaagggcaaccccaccgtgtccgccgagcgcgccgacctccgccgctgcaacgactcctcgtcgtccggcggcacgcgcgtgttctggcaggactggggcgccgccatccgggacggcttccgggactccaacctggccaagcagtgccgctaccgctacaagatctacgtgcgtggccggtcctggtcggtcagcctcaagtacatcctcgcctgcgactcgccggtgctgctcatcgccacgcccttcaaggacttcttctcccggggcctcgtcgccggcaggcactactggcccatcgaccccggagcccgcaagtgcgccgacatcaacttcgccgtccacgactggggcaacgcgcacccggagcaggcgcgccggatggcggaggaaggcagcggcttcgcgcgccaccagctcagcatggactacgtctacgactacatgctgcacctgctcacccagtacgccggcctgctccgctacaagcccaccgtgccggagaacgccgtagagctgtgcgccgagaccgtcgcctgccccgctgcgcaccacagcaacaggagggagttcgacttcatgatgcagtccagggagaggtacatcgccgactaccagccctgcacgctgccgccgccctttaccgaccgtcacatcagggagatgacgcgaagagaccaggaggtgcgcgccaacgtgcacaagatgatgaccaccgtcactccatgacgtcaccaattaagggattctcttgttctctatctatctatctatcttgaatatccacttcgttatactacgtcctggtctctag

SEQ ID NO: 138 - DNA, 1403 bp, Zea mays
gaaaccacagccgcttctggcgggcgctcaccctgccccttccacctcgcctcgcctcgcaatggaggtttccaggtggaccccggcggccggcctcctgctcctgttgctcctcccgctcgcggccaccccgtcacgcgccgccacgatggcgagatcgccgtcgtcgtccactgccgtgttccagctccagggagacgtataccccaccggccactactatgtcacgatgaacattgggaacccagcgaagccctacttcctggacgtggacactggcagcgatctcacctggctgcagtgcgacgcaccctgtcggagttgcaacaaggtgccacatcccttgtatcgaccaacggcaaaccgccttgtaccgtgtgcaaacgcactctgcactgcacttcacagcggacagggctctaataacaagtgcccttcaccaaaacaatgcgactatcagataaagtacaccgacagtgcatcttctcagggtgtgctgatcaacgacagcttctcactgcccatgagatcctccaacattcgtcctggcctcacatttggctgtggatatgaccagcaagtggggaaaaatggcgctgtgcaggcagcgattgacggcatgcttgggctcgggaggggatcagttagccttgtttcacagctcaagcagcaagggatcaccaaaaatgtcgtcggccattgcctaagcacgaatggaggggggttcctcttctttggggatgatgttgtgccttcatcacgtgtaacttgggtgccgatggctcagaggacatctgggaactactactcacctggctcaggaacactgtacttcgatagacgttcactaggcgtgaagccaatggaggtggtatttgacagtggtagcacctatacttattttactgctcaaccataccaagctgttgtttctgcgctcaaaggtggtctcagcaaatcacttaaacaggtgtcagatcccactctgcctctgtgctggaaagggcagaaagcattcaaatctgtgtttgacgtcaagaatgaattcaagtcaatgtttctgagctttgccagtgccaagaatgccgccatggagatcccacctgaaaactacctcattgtcacaaaaaatggaaatgtgtgcctgggcattcttgatggaacggctgccaagctgagtttcaacgtaattggagacatcacgatgcaggatcagatggtgatctatgacaacgagaaatcgcagctgggatgggcgcgtggggcatgcactaggagcgccaagtctattctgtcttcctttccctgagctcagttctatgtacttctgatagagtttaagaaaatcactatatcaaacctcctcgcaatgcatgaatttcctaactgaagagggagggaga

SEQ ID NO: 139 - DNA, 4376 bp, Zea mays
gcgagatggacgcggcgggggacattcagaaggtggcgagtatgcggcggggcgacagcggctccatttggcggcgcggtgacgacgtgttctcgcgctcctccagggaggaggacgacgaggaggcgcttcgctgggccgcgctagagaagctgcccacctacgaccgcgtccgccgcgccatggtcccgctcggcctcggcgccgacggcgccgaggcggcgggcaggaaggggctcgtcgacgtggacgtgctcagcctcggcccacgcgagaggcgggcgctgctggagcgcctcgtccgcgtcgccgacgaggacaacgagcggttcctgctcaagctcaaggaccgcgtcgacagggtcgggatcgacatgcccacgatcgaggtacggttccagaaccttgaggcggaggcggaggtgcgcgtcggcagcagcggcctccccaccgtcctcaactccgtcgtcaacacgatcgaggaagcggcgaacgccctgcacatactgcccagtaggaagcggatcatgcccattcttcacgacgtcagcggaatcatcaagcctcgcaggatgacacttctgttaggtccgcctggatcaggcaagaccactttgttgctcgccttggccggaaggcttgacaaagacctcaaggtttcaggcaaagtgacctataatggtcatgagatgacagagtttgttccagagaggacggccgcttacatcagccagcatgacctccacataggagagatgactgtgagggagacgcttgcattctctgcacgctgccagggtgtcggctcccgttttgatatgctgactgagttgtcgaggcgagagaaggcggctaatatcaagcctgatgctgatattgatgcattcatgaaggcgtctgcaatgggtgggcaagatgccaatgtggtcactgactatattctgaagatattaggactagagatatgtgcagacacaatggtaggggatgagatgctcaggggcatatctggtggacaacggaagcgcgttacaactggtgagatgctggttgggccagccagggcgcttttcatggacgagatctcaactgggcttgatagctccactacattccaaattgtgaactcgctgaggcagtccattcacatcctcggtggcacagctgttatctccctactgcagccagcacctgagacatataacttgtttgatgatatcatactcctctcagatggtcaggttgtgtaccagggtcccagagaagaagtgcttgagttttttgagtctgtaggtttcagatgccctgagaggaagggcgttgctgacttcctgcaagaagtgacctcgaaaaaagatcagaaacagtactgggcgcgacctaatgagccctacaggtttgtggctgtgaaggaatttgcgactgcattcaagtcatcccacacagggagatctataacaaatgagcttgctgttccgttcgacaagagcaaaagccacccagccgcactaaccaccacaaggtatggtgtgagtggcaaggagctgctcaaagcaaacatagaccgggagatccttctcatgaagaggaactcttttgtctacatgttcagaaccttccagctgatgctcatgtcaatcattgcaatgactctcttcttccgtaccaagatgaagcatggcacggtgaatgacgggggtctctacatgggcgcactcttctttggtgtgcttatgatcatgttcaatggcttctctgagctggcactaactgtcttcaagctgcctgtattcttcaagcagagggatctccttttctttccagcatggtcctatactataccctcatggatcctcaaggtacccatcacatttatcgaggttggtggttatgtattcttgacatactatgtcattgggttcgacccaaatgtcggcaggttcttcaagcagtatctgcttctgttagtagtcaatcagatggcagcatcactcttccggtttattggtggggtatcgaggaacatgattgttgctaatgtcttcgcatcgttcatgttgctagttgtcatggtgttgggaggatttattctagtaagagataaagtgaagaaatggtggatctggggctactggatctccccaatgatgtatgcacaaaatgccatttcagtgaatgagatgttgggccacagctgggacaaaatattgaatagcactgcatccaacgagaccctaggtgtgcaagtccttaagtcgcgtggagtattcaccgaagcaaagtggtactggattggctttggtgctatggttggtttcaccatactcttcaacgctctcttcactgttgcccttacatatcttaagccatatggcaactcccggccatctgtatccgaagaggagctgaaggagaagcatgcaaacatcaaaggggaggttctggatggcaatcacttggtatcagcaagcagtcatcgatcaacaggagttaaccctgaaactgattcagcaatcatggaagatgattctgccttgactaaaaggggaatgatcctcccatttgtcccgctctcgctcacctttgacaacatcaaatactctgttgacatgccacaggaaatgaaagctcaaggtgtacaagaagatcgtttggagctcctcaaaggtgtcagtggatcttttaggccgggtgtgttgaccgcactgatgggcgttagcggtgcaggaaaaactactttgatggatgtgttggctgggagaaagacaggtggatacattgaaggagacatccgtatttcaggatacccaaagaaacaagacacctttgcacgtgtatcaggatactgtgaacaaaatgatatccactcgccacaggtgacagtctatgagtccctgcttttctcagcatggctccggcttcccaaggacgtcgattcaaacaaaagaaagatcttcattgaggaggtgatggagcttgtggagctgaaaccactgagaaatgctttggttggacttcctggagtgaatggtctgtcaactgagcagaggaaaaggcttaccattgctgtggaacttgttgcaaatccatctatcatctttatggatgagccaacctcagggcttgatgcccgagcagctgcaattgtgatgcggacggtgaggaacactgtcgatactggtagaactgtggtctgcacgatacatcagcctagcattgacatatttgaagcatttgatgagcttttcctcatgaagcgtggtggagaagagatctatgctggtccacttggacatcattcttcagatctaatcaagtattttgagtcacttcatggggtcagcaaaattaaagatggctacaatccagcaacatggatgctggaagtgaccacaacttctcaggaacagattctaggtgttgatttcagtgacatatacaagaaatctgaactctaccagaggaacaaggccttgataaaggaattgagccaaccagcaccaggttcaactgacctgcatttccctagcaagtatgcgcagtcttccattacacaatgcgtggcttgcctatggaagcagaacctgtcatactggaggaaccctccttacaataccgttaggttctttttcactaccatcattgctctcctccttggcaccatcttttgggacctcggcggcaaaacgtatacatcacaagacttgatgaatgccatgggatcaatgtactctgcggtgctgttcattggagtcatgaattgtacctcagttcagccagtggtggccgtggagcgaacagtcttttaccgtgaaagagctgctggcatgtactcagctttcccatacgcgtttggccaggttgtcattgagcttccatacgcactggctcaggatatcctttacggtgtcatagtgtactctatgatagggttcgagtggacggctgctaagttcttctggtacctcttctttgggtacttcacgctgctctacttcacattctacggcatgatggccgtggggctgacacctaactaccacatcgccgcgatcgtctcctcggcattctacgccatctggaacctcttctccgggttcatcatcccccgaccgaaagtgccgatctggtggaggtggtactgctggatatgccccgtggcgtggacgctgtacgggctggtggtgtcacagttcggtgacgtcatgactccgatggacgacggaagggccgtgaaggtgttcgtcgaggactacttcgacttcaagcacagctggcttgggtgggtggccgccgtggtggtggcgttcgccgtgctctttgcgaccctgtttggctttgccatcatgaagcttaacttccagaagagataataa

SEQ ID NO: 140 - DNA, 1571 bp, Zea mays
attccggtgggtaagacagagttgggggagcgtcggttagttaattcttcgcccatcctcagtcggaggagagacaggaggaggtgcatggccggcatggagggttccaattccagctcgcagccgccgccgttcctcatcaagacctacgagatggtggaggacccggcgaccaaccacgtcgtgtcgtggggccccggcggcgcaagcttcgtggtgtggaacccgccggacttctcacgggacctgctgcccaagtacttcaagcacaacaacttctccagcttcatcaggcagctcaacacatacggtttccgaaagatcgatcccgagagatgggagttcgccaacgacgacttcgttagggggcacacgcacctcctgaagaacatccaccggcgcaagccggtgcacagccactcgccgcagacccaggtgaacggcccactggcggagtcggagaggcgcgagctcgaggacgagatcagcaggctcaagtacgagaagagcctgctcctgacggacctccagaggcagagccagcagcggtgcgggatcagctggcagatgcagtcgctggaacgcaggctggcgcagatggaggagcgccagaggaacatcgtggcctccctgcgcgacatcctgctgccggtcggacacggggtcgtttcgtgggggtcggcgacgggggcggaccacttcagcaagaagaggagggttccgaagatggacttcttcgtcgacgaacccaaggtcgaagaacagcaggtgccgttcctgcagacggtgggcgcggagacgccaggcatgtctccgatccgccttctgagcgccgagccgtttgagaagatggagctggccctggtgtcgctggagagtttcttgcagagggcaacagcgcatacgtctgctgctcaaggcatgttgtacgccgctggtgttgctgaacccagccctgctctggctctaggcgagatgctctcggcaccaatggataccgagatcgatctgcagccatcagcttgccagaaccccttcgcttcgacctcagggcaagaccagtcgtcttctccgttggcagaacccccgagctactacgcccagagcccgatgctgccgatggcacagctccatgaacatgcccataggacagctgctggagtcgatatgaactctgacaccacaaccggcgacacctcgcaagatgataccaccagtgaaactggaggttcccatgtgccggccaaagtgaacgatgtattctgggagcggtttctcacagacgccgccgagggtaaaagcgaggcaatagaagcaaaacaagatgtgaagactgccgtagaccgctgctgtcctcgtctccaggacaatgttgatcagatcactgagcagatggggcagcttgattcagcttcttatgcacccgagaattactgataccacaccatcggtgttgccgctgtacattatagtttaggctagctaagtcttttctagcatttcctactgtaaaaagtaaaatcatatgctgacccatgtacattacgtatgtcctcgtgctgttgagctag

SEQ ID NO: 141 - DNA, 501 bp, Zea mays
cttcaataacccagtcggcaggcgtgacccgatgctctcgcgtcgtcggatcgtcgccaccgtctcctccgcgtcgcctacaccgacatggacgaccggcagtatgccggactgaccaaggcaggcttgggcgtgctggccttcaactcgggcctcgccatctacaactcctggggcgacgcgagctccgtcgcgttcgtgctctccgcggactccatcctcgtgctgctcttcctctgcctccgtgagctggagctgcaggggcggggggccgccggcaggggcagggatgtcgggatcatcagagccgcggtgtggacgctgacgacgctgctctcggccatgttcgcgtctagggtggcgccgctgatgccgcccgtcgtcggcgcgctcgtctgggcgacggctgtggccactgccgccggcggcttctgggcggtcttcctcagctgaatgtttaggcttagttcgacgagagagtgatcctgtgcgtgctactag

SEQ ID NO: 142 - DNA, 515 bp, Zea mays
agaccatggacagcaagctgggcgtgcagcacgggcaccgccaccaccacagccacaacggcgtctccaagccgccggtcgcaaggaggaggcagagcggcggcggcggcggcaagggggtcaaggtggtgtacatctccagccccatgaagctcaccgccagcgccgaggagttccgggccatcgtgcaggagctcaccggccgcgactccaacgtcgccgaccacgacctcgacggcggcggcgcctaccacgtgggcgcgccgtcgtcgaccacgaccacgacgacttcctactcctccctcggacgcgtctccccggccgtggcggaggcggcggccgccgcagcggcgggagcccgcgctcggtcgtcgccggcgaccaacgccgggggggcgtcgccggtggtcgagtacgccgccgcgatggcccagccgccgccgttccagttccagggcatgtacgaccaccagattgccgggagcttgctttacggcctggacaactggtagtag

SEQ ID NO: 143 - DNA, 1132 bp, Zea mays
tgggcttctctcaccaacacccgcgatgtcatcctcctcgccgccgccgccgcacgtcgtcgaggacatgccccatgtcctccagcttctcagcgacggcacggtggtccgcttcgccgactacgacacgctccctcccccgtccgtgcctcccgcgccgctgcccgtccggtggaaggacgtcgtgtacgacgccacccacggcctcaagctccgcgtgtacagtcccagtccgccggcctcctgcggcaagctgcccgtgctggtctacttccacggcggcgggtacgtcctcggcaccttcgcgctgcccagcttccacgcctgctgcctccgcctggccggcgagctcccggccgtcgtgctttccgccgactaccgcctcgcgccggagcaccgcctccccgcagccctcgacgacgcggcggccgtcatgcgctgggtgcgcgcccaggccgtcgcggcggggggaggggacccctggctcgccgactcggctgacccgggccgggtgttcgtcgccggcgactcagcgggcgggaacatcgtccaccacgtcgccgtccgccgcctcggctcggcggcctcgggcgaggagctcgacccggtacgcgtcgccgggcacgtcatgctctgcccgttcttcggcggggccgagaggacggcgtccgaggcggagttcccgcccggcccgttcctgacgctgccgtggtacgaccaggcttggcggctgacgctgccgacgggcgccacgagggaccacccgttcgcgaacccgttcgggccggagagccccgcgctgctgggcctgcgcgacgtcgcgctcccgccgacgctcgtcgtggccgcggggcaggacctgctgcgcgaccgccaggcggactacgtcgcgcggctcaaggcgatgggacagcacgtggagcatgtcgagttcgagggtcagcaccacgggttcttcaccgtggagccggccagcgacgccagcagcgagttggtccggctcgtcaagcgcttcgtgtatggcgacggcgacggcaactccatctaaactggactcatgagccatcatgatcatgacctttgttgttagcttagcacgagtactcgcgtgacacgaacagagctgaagttg

SEQ ID NO: 144 - DNA, 1644 bp, Zea mays
atatacgtgccggtaaatggtgccagcatcgtctcgtcgccatgtatttaagcgtgccggtgcagctaattggttccagatcttatcccttccagttccaggcagcatccccagcctgacgaaggaattgaggacgctcgagctcgagctacgtcaggatccaacaccaccatggttacgggaaagaagaggacgttcgtgctctacccgtcgctgggcgtgggccacctgatcccgatggtggagctggccaagcacctcttgcgccacggccacggcgcgctcatcgccgtggtcaacccgcccgacaccgacgccgtgtcggccgccgcggtggagcgcctcgcggcggccaacccggccatcgcgttccgcctcctgccggtcccggccagcccggacgccggcgcggactgggtgaagcgcgacctggacacgctccggctcgccaaccccgtgctccgggacttcctgctccggtcccagcccgcagccgacgccgacgcgctcatcctcgacatgttctgcgtcgacgcgctcgacgtcgcggcggagctcggcgtcccggcctacttcttcttcgcctccgcggcgggggacctcgccatgttcctcaacctgccgtacctctaccccaccctgccgtcgttcagggacatgggcgaggcgccggtgcgctgccccggcatgccgccggtccgggcgatggacatgccgctgacggtgcaggacagggacagcgaccggaccaaggtccggatgtaccagttccgccgcatcccggaggggaggggcgtgctggtcaacagcttcgcctggctggagcccagggcactgagagcgctcggcgacggcgtctgcgtgcccggccgcccgacgccgagggtcttctgcgtcgggccactggtcaacgacggcagcagcacggcggggggcggggggaggcacgagtgcctggcgtggctggacgcgcagcctaagcggagcgtcgtgttcctctgcttcggcagcaagggctccttccccgccgcgcagttacaggagatcgcccacgggctggagagctccggccaccggttcctgtgggccgtgaggagcccgccggaagaaccggacacggacctggggaagctgcttcccgaagggttcctggacaggaacagagacagaggcatggtggtgaaggactgggtgccacaggcagaggtggtgcggcacgaggcggtccgcgcgttcgtcacgcactgcggctggaactccacgctcgaggccatcatgtctggcctgcccatgatatgctggccgctgtacgcggagcaggggctcaacaaggtgttcatggtggaggagtggaggatcggggtggagctgcgcgggtacgaaaagttcgtcaaggcggaggagctggaagcgaaggtcagactggtgatggaggctgaggaagggaggatcctccgggagaggctcgcggtggcgagggagaaggcgttgggggctactaaggaaggcgggtcttctgaagtggcattcgcggagttctttggagatttggacaagagcagctctccgtcggtaaacggagaatgcgattgaattgatcactggtgtgctggtgtggcagatggactgcgaacgtatatatag

SEQ ID NO: 145 - DNA, 782 bp, Zea mays
gcacaatggagcactacgactcctatctatgcagcggcagcatgcatagctacggcggcgttggcggagccacggacgcggcgttggacgccggcggtgacgacatgcagcgcctgctcaacgcgctcatggacgacatggctgccgagtccgactccttctccgacgacatggaggcagcctcctccgagtcctcgtcctccgcctgctcggccaacagccagcaggaggccacccggcggccacagcagcaaccggacggtggccacagcaacggtagcaacaagagctccaagaagcagcatcagcagcaatcgccggctccctacatcggcgtgcgcaagcgtccctggggcaagttcgcggccgagatccgcgactccacgcgcaagggcgcccgcgtctggctgggcaccttcgacagcccggaggccgccgcgatggcctacgaccaggccgccttctccgtgcgcggcgccgccgccgtgctcaactttcccgtggagcgcgtgcaggagtcgctgcgcgcgctggcgctctcttccgcctcctctgccgcgggctcccctgtcctggcgctcaagtgccgccactccatacgcaagcgctccccgaacaagaacaagaacaagaagcaggagcggcagcaacaggtggccgtggccgccgccggaccacagcagccgccgtgccccaccagcgttgtggagctggaggacctgggcgccgattatctggacgagctcctccgggtgtcatccgagttccattggcaataatag

SEQ ID NO: 146 - DNA, 1488 bp, Zea mays
cagtcacccacaaccaattagccattggccagcacagcagtgtataggcatagctacgtacgtgggaagtgggaacgatggcactcatcatgcaggagagtagtagccatgatttgctccaagctcacgacgagctcttgcaccattccctgtgcttcgccaaatcgctcgcgctcgccgtggcgctggacctccgcatccccgacgcgatccaccaccacggcgccggcggcgccacccttctccagatcctcgccgagactgcgctccacccaagcaagcttcgcgcccttcgccgcctcatgcgcgtgctcaccgtcacgggcatcttcagcgtcgagcaaccaccagcaggtggtggtgataattcaaccgtccacacgtcggacgacgaagctgtcgtcgtctacaggttgacggcagcctcccgcttcctcgtcagcgacgaggtgagcacggcgaccttggctccctttgtgagtctggcgctccagcctatcgctgcctgtccgcacgccctgggtatctccgcgtggttccggcaggagcagcacgagccgtccccgtatggcctggcgttccggcagaccccaacgatctgggaacatgctgacgacgtaaacgccttgctgaacaaaggcatggccgcggacagccgcttcctcatgccaattgtgctgagggagtgcggcgagacgtttcgtgggatcgactcgttggttgacgtcggtggtggccatggtggcgccgccgccgccatcgccgccgccttcccccacctcaagtgcagcgtgcttgacctcccgcacgttgtcgccggtgctccgtctgatggcaacgtgcacttcgtcgcaggcaatatgtttgagagtattccacctgcaaccgctgttttcctcaagaaaactctacatgactggggtgacgatgagtgtgtcaagatattgaagaattgcaagcaagccatatctccacgggatgcaggtgggaaggtaataatcttggacgtggtagttggatataaacagtcaaacataaagcatcaagagacacaagttatgtttgatttgtatatgatggcggttaacggagttgagcgtgatgagcaagagtggaagaagatcttcattgaagctggattcaaagactacaaaattctacccgtcatcggtgacgtatcagtcatcatcgaggtctatccttgaatgctttgtgaacaaagacctccataataaactgaagaccatgaaggtgttgatagtatattatgattttttatttgtattgtacacttgattctttgagtatttgtaatgacaagctgagtaattgtgtttttttgttaatgtggtcttatagtgcacattacacatgatgtatgatatgttacttgccctcattttggtgtagatgtgtgttggtcaagtagtcgataggcaactctattatgcttggcatcaataagacaacatggaagcctatgatttg

SEQ ID NO: 147 - DNA, 1095 bp, Zea mays
ctagacgcacctccaactgcagcgcgccatacttgaccgcatcagcatggcatccacggggacgacggcggcggcggtgccggaggtgaccctgcggtcgggcaacggaaagccgatgccgatggtgggcatgggcacggcgtcgttccccgtggtgcacgaggccgtcagggacgccgtgctggcggccatcgaggtggggttccgccacttcgacacggccttcctgtacggcaccgagaagccgctcggcgacgccgtggccgaggcgctgcggcgcggcctcctgaggtcccgggaggagctcttcgtcacgtccaagctgtggtgttcgcagacccacgcggacctcgtgctgccgtccctgcgggaaactctcgagaacctgcagatggagtacgtggacctgtacctgatccactggccggtgtgcctcaggccggccggcgggccgcccaagttcccgaacaggaaggaggacgcggtgccgctggacgtggcgggcgtgtggcgcgccatggaggagtgccagcggctgggcctcgccagggcgatcggcgtcagcaacttcaccaccaggcacctggacaaggtcctggccatcgccgcggtcccgcccgcggtgaaccaggtggagctgaacccggcgtggcagcagcggacgctgcgggcgtactgcgccgaccggggcgtccacgtcgccgcctactcgccgctgggagggcagaactgggacgggcggggcaacgccgtgctcgactcggaggtgctcgcggagatagccagggcgagggggaagaccgtggcacaggtggcgctgcgatggatacatgagcagggagtgacgtgcatcgtcaagagctacaacagggagaggctgaagcagaacctcgagatattcgactgggagctgaccgatgacgaccggctcaagatcagccacatcccgcagaggaaggttgtcgaggccagcggcttgttctcgcaggagggtgagttcacgtccgttgatccagcggaactgaatattgtggaggaataggaactggactggaaaatggcccccgcctgtcggtgttgctccgtataggaaca

SEQ ID NO: 148 - DNA, 2576 bp, Zea mays
agagcatgtggtcgtcggagatgggtcgaagaagccgccgaacgaacggcatggtggcagagccgcagacgacgcagctgctgctgcacggggtgatcgaggccaccatcctggaggccgacctgtccgtcaccacagacggcaagctgcagccgaccaagaagactctgatgaagaagaaggtcttctcatggatcaggaagctgacattctgcagaaaccagctggagaacgccatcggtctcggcacggacggcaagctgtacgcgacggtggacatcgacaaggcgcgcgtggggcggacgcgcatggtgccccccgtccactcccccatgtgggacgagtccttccacctctactgcgcgcacgacgccagcaacatcatcttcaccgtcaaggccgacaacgccatcggcgccacgctcatcggccgcgcttacctgcccacggagggcgtcgtcgccggccggaaggtggacctgtggctccccatccgcgacgagaagcgccagccgctggaaggcggtgaccagatacacgtccaggtccagttcaccgacgtcgccgcggacccgaccgccggctggggcgccgggatcggcagcgcggcgtacggcggcgtgccctacaccttcttcaagcagcgccgcggatgccgggtgcggctgtacgaggacgcgcacgtggccggcgacttcgcgccgcgcgtccggctcgcggacggcagcttctacgagccgcgccggtgctgggtggacgtgttcgacgcaatcaaccgggcccggaggatggtgtacatcgccggatggtccgtgaacaccgacgtggtgctggtgcgcgacccgcgggaaccgtcggcgtcgtccgagagtctcggcgagctgctcatccggaaggccgacgagggcgtcgcggtgctgatgctggtgtgggacgaccgcacctcggtggggctcggccccatcaagcgcgacgggctgatggccacgcacgaccaggacacggcgagcttcttccgcgacacgcgcgtgcagtgcgtgctctgcccgcgcaaccccgacaaggaccggagctacgtgcaggacatcgagacggccaccatgttcacacaccaccaaaagacggtgatcgtcgacggcggcggcgcgccggcgccggagacgccgccgggcctcgtgagcttcctcggcggcatcgacctgtgcgacgggaggtacgacacgcaggaccacccgctgttccgcacgctgggcaccacgcacagcaaggacttccaccagcccaacttccccggcgcgtccatcagcaagggcgggccgagggagccgtggcacgacatccactgccgcgtggaggggcccgcggcgtgggacgtgctggagaacttcgagcagaggtggaagaagcagggcaagggggacaacctcctggtggcgctgaacaaggcgtgggcggagcgcgaggcggccccgcggggcgacgccgagtcgtggaacgtgcaggtgttccggtccatcgacggcggcgcggcggcggggttcccggagggctccgcgaacgcgccccgggaggcggcggcgctcgggctggtgagcggcaaggaccacgtgatcgagcgcagcatccaggacgcgtacatccacgccatccggcgggcgcgggacttcatctacatcgagaaccagtacttcctggggagctcctacgcgtggcggcagaacgacggcgtgacggtggaggacatcaacgcgctgcacctcatccccaaggagctgtcgctcaagatcgtgagcaagatcgaggccggcgagcggttcgtcgtgtacgtggtggtgccgctgtggccggagggcgtgccggagagcggctccgtgcaggccatcctggattggcagcgccgcaccatggagatgatgtataaggacgtgacgctggccatccgcgccagggggctccgggccgaccccagggactacctcaccttcttctgcctcggcaaccgcgaggcgccgagccccggcgagtacgtgccgccggagcacccggaccccaacaccgactacgagagggcgcagcaggccaggcgcttcatgatctacgtccacgccaagaccatgatagtggacgatgagtacatcatcgtgggctcggcgaacatcaaccagcgctccatggacggcggccgcgacacggagatcgcgatgggcgcgtaccagccgggctacctggcgaccaggaaccggccggcgaaggggcaggtccacggcttccgggtctccctgtggcaggagcacctgggcgaggcggcggcggcgggaatgggcgacgatctcttccgtccgtcgagcctggcttgcgtgcgccggatgaaccaggtggccaagcagcactgggacatgttcgcgagcgacgcgttccagggcgacctcccgggccacctcatggcgtacccggtcagcgtgctcgacgacgacgacggccgggtcgtggccacgacggaaaccttcccggacaccaacgccaaggtgctcggcaacaagtccgacatcctcccgcccatcctcaccacatgatga

SEQ ID NO: 149 - DNA, 1025 bp, Zea mays
tcgtcatgaggtcgacttggttggcatttgccttgtcggcgctcgtcgtcgtctcctcatcagcggcacacgtacacgcctcgccggggaaacttgaggtcggtttctacgagcactcatgcgcacaggccgaggacatcgtgcgcaacgccgtccgccgcggcatcgcccgtgagcccggcgtcggcgcggggctcatccggatgcacttccacgactgcttcgtccggggctgcgacggctccatcctcatcaactccacgccgggcaacatggccgagaaggactccgtggccaacaaccccagcatgcgcggcttcgacgtcatcgacgacgccaaggccgtcctcgaggcgcactgcccgcgcaccgtctcctgcgccgacatcgtcgcgttcgcggcccgtgacagcacctacctcgccggcggcctggactacaaggtcccgtctggccgccgtgacggccgcgtgtccaaagaggaggaggtgctcgacaacaatgtccccgccccgactgacgaggtcgacgagctcatcgagagcttcaagcgcaaggggctcaacgccgacgacatggtcacgctctccggcgcgcacaccatcggccgctcccactgctcctccttcacgcagcgcctctacaacttcagcgggcagctggggcagacagacccgtccctcgaccccgcctacgccgggcacctaaaggcgcggtgcccttggccgtccagcgacgaccagatggaccccacggtggtgccgcttgacccagtcacgccggcgaccttcgacaaccagtactacaagaacgtgctggcgcacaaggtcctgttcatctctgacaacacactgctcgacaatccctggacggccggaatggtccacttcaacgccgcagtcgagaaggcatggcaggtcaagttcgccaaggccatggttaagatgggcaaggtccaggtgctcaccggcgacgagggagagatcagggagaagtgcttcgctgtcaacccacactactagtaa

SEQ ID NO: 150 - DNA, 3310 bp, Zea mays
aacttccggctatgtgcttgcccacgcctgaagtcgccgtcacgtccttacgcgtcaacggcacggccccacgcgggtgagagaggagagccgccccccacgcacccgcgtgaatatatactcgcgcggccacggcagggttggtgggagagcgaattcgagctggtcgaatccggcagccgagcgagatggagagctacctcaaggagaacttcgggggcgtgcaggccaagcactcgtcggacgaggcgctgagacgatggcgcaaggtcgtcggcctcgtcaagaaccccaagcgccgcttccgcttcacggccaacctcgacaagcgcaacgaggccaccgccatgaagcgaaataaccatgagaagctacgtgtcgccgtgcttgtttcaaaggctgcacttcagttcattcacagcgttgctccgtcgagtgagtacaaggtccctgccgatgtcaaggcggctggtttcggcatctgcgctgaagagctgagctcgattgtcgaggggcatgatgtgaagaagctgaaatctcatggtggcgtgcagggcctcgcgtccaagctatccacttcggagtctgacggcctcaccacgtccgcggacaagctagcgacccggcgggatgtttttggcgtcaacaagtttgcggaggcggagtcccgtggcttcttggtcttcgtctgggaggcgttgcaggacatgacactcatgatccttgccgcgtgcgcgttcttctcgctcatcgtcggtatcgccacggagggatggcccaagggcgcacacgacggcctcggcattgtggccagcatcctgctggtcgtgttcgtcacggcgtcaagcgactaccgccaatccctgcagttcaaggaccttgacaaggagaagaagaagatcacggttcaggtcacccggagcggctacaggcagaagctctcaatatatgaacttctcgtcggcgacatcgttcacctctccattggtgatcaggtgccggctgacgggctgttcatgtcaggcttctcgcttctgatcaacgagtcgagcttgaccggagagagtgagccagttgccgtcaacgttgagtacccattccttttgtcagggacgaaggtgcaggacggttcttgcaaaatgctcgtcacgacagtcggcatgaggactcagtgggggaagctgatggccactctcagcgaaggtggtgatgacgagacaccattgcaggtcaagctgaatggtgtggccaccatcatcggtaagataggacttatctttgcagtggtcacattcgcagtgctcacccaaagcctgttccggcgcaagatcattgatggtacgtacttgagctggactggagatgacgcattggagctgcttgagttcttcgccattgctgtcaccatcgtcgttgtggcagtacctgaagggctaccgctggccgtgacactgagccttgcatttgcaatgaagaagatgatgaacgacaaggcactcgtccggcaccttgcagcctgcgagaccatgggctcagcgacctccatttgcagtgacaagacaggcactctcacaacgaaccacatgaccgttgtcaaagcctgcatctgtggtaagatcaaagaagtggatggtgtttcggatatcaagaacctgttctctgaactcccagactctgtcatggcgattctctcccagtccatattcaacaacactgggggagacgttgtcttgaaccaggatggcaaacgtgaaatactggggacacctactgagacagcgattctagagttcgggctgtcacttggtggagactttttggcggtgcgcaaagcaagcactcttgtaaaggtggagccgttcaactctgccaagaagagaatgggagtggtaatccagctcccagagggtgcactgcgagcacactgcaaaggtgcatcagagatcatactggcatcttgcagcaagtacctgaatgaagatggcaatgtcatccccctggatgcaggaaccattgatcacttgaaggccacgatcgatagcttcgcgaacgaggcacttcgcactctctgtcttgcctacatagaagttgaggatgggttctcagtcaatgatcagatcccaacggatgggtacacctgcattggcattgtggggatcaaagacccagtgcggcctggagtgaaggaatcagttgctatctgcaggtcggcaggtattacagtcaggatggtcacaggtgacaacatcaacacggcaaaggcaattgcccgggaatgcggcattttaactgaaggtggcattgccatagaaggcccagatttcagaaccaagagtgaagaagagcttactcaactgataccaaagatacaggtgatggcaagatcttcgccactggataagcatacccttgtcaagcatcttcgaactaaactctacgaagttgtggctgtgactggtgacggaacaaacgatgcacctgctcttcatgaggctgatattgggcttgcaatgggcattgctggaaccgaggtggccaaagagagtgctgacgtcatcattcttgatgacaacttctccacaattgtcactgttgcaaaatggggtcgatcagtttacatcaacattcagaagtttgtgcagtttcagctcactgtcaatgtggttgctctggtggtaaacttctcctcagcttgcctgacagggagtgctcctctcactgctgtgcaattgctctgggtcaacatgatcatggatacactgggtgcgctggcattggcgacagaacccccaaacaatgaactgatgaagagaacacctgttggaaggaaaggaaacttcatcagtaacattatgtggagaaacatcctgggacaggccttgtaccagttccttgtaatttggtacctacagacagagggaaagtggctgtttggaatcaagggcgataactccgatctagtcttgaacacactgatcttcaattgcttcgtgttctgccaggtattcaatgaggtgagctcaagggagatggagaggataaatgtatttgaaggcattctaaacaacaacgtgttcattgctgtcctcggcagcaccgtcatcttccagttcatcataatacagttcctcggcgatttcgcaaacactacccctcttacgctcaaccagtggatcgcatgtgtttttatcggtttcataggcatgcctatcgcagctattgtgaagatgatcccagttggatctacgtagtgaattagagctaatttcgtccagaaactgaagttggacatggctacagtctgatcatg

SEQ ID NO: 151 - DNA, 2051 bp, Zea mays
tctccgtccgttctaacttctgcggcgcgcgaaggtactgtgggaatcgctgctctttccttgattccggcggcggcggaggtgcgcgggtaacgttcgtcgcgccgtgggggtgcgagggaggcgccgcgcgcggcctcggattcgatcggacacagcgtccgtcgcgcggcggcggcggtggccgacgacggatggagtcggtgaaggggtgggtggccgccgactacgcggcggagcccatggcgtcggtgcagcactcgctgcgcgtcgcctacgtggtcttctccttctgcgccgccttcttcctcggcggcatcaaagcggtggttgtcgggcccgttgccgccgccgtgatgatagtgggcaacgtcggcgtcatactcgtgctcttcccggcgcacgtctggtgggcaatctactcgctcatcaagaccgaccgcatcaacgcgggcctgaaactagctgtgctcttggcgctgcccgtgctgttcggcctctggctgggtctgggcatcttgggcagcgcgctggtgggtctcgggtacggcttcttcacgccgtggatctccaccttcgaggcgttccggcaggaaagcgaggccaagaagttcgtgcacggcattgtggatgggacgtggggcacgatcaagggcagctgcacggtggtcagggacttcgcggacatctgcttccactcctaccctgtctacctcaaggagctgcgcgagggctcccagaatcgtgagccccattccataaggttgctggacgtgccctcatgcatagtcgtcgctctcctcgggctagtcgtggacataccactttacacggtgattgcgctggtcaagagcccctacatgctcttcaaaggctggcagaggctgctgcacgaccttataagccgagaaggcccgttcctcgagacggtctgcgtgccgatcgccggcctggctatcctgttctggccgctggtggtggtcgggagcgtcctgctggccatcgtctccagcatctttgtggggctctacggagcggtcatcgttttccaggagaggtcgtttcagaggggcgtttcgtatgtcgtggccatggttgcggagttcgatgagtacaccaacgactggctctacctccgtgaaggaacagttctcccgaagccgtcctacagaaagaggaaaccgtcgaactccacggaattctcggtgagaacaaacgcctccggcggcaaaggagctgaccaccctcctggccccagtgaagcaccggcaatgttggtgccgaatctggctcctgcgagatcagtgagagaggctatacaggaagtcaagatggtccagatatgggagaacatgatgaagtcatgcgagcagcgggggagggacctcctgaaccagaacgtgataacggccgcggggctggcggagtggctgaggggggcgaaggagggcgggcaccacgagaccgtgagcctgggcctgccgtcctactcgctgctgtgcaccgtgctgcagtcgatcagggccgggtccgggggcctggtgctgggcagcttcgaggtgaaccagcacaaccggccgcaggaccggctgctggactggttcttccaccccgtgctggtgctcaaggagcagatacaggcgctgaggatgaccgaggaggaggtcaggttcctggagaagctgaccgtcttcgccggcaacgtcgcgggcgctggcgctgccgggtgggagaacggcgccgggatgatggtggtgccccaggaccctgtgaggctggcgcagatccaggccatcagtagaaggctggttgggattgtgaggagcctgtccaagttcccgacgtacaggaggaggtacaggcacgtcgtgaagctgctcatcgcctactccgtcgagagggagagctcgggcaggtcgtcggcttcagggcgctcggcttcctactttgagataacacagctggacgtgtagtatagtttgtgaagcgttctccgattgtaattaagctgttaatttctaggatcaggtagtagctgtcagtgccttcgt

SEQ ID NO: 152 - DNA, 1503 bp, Zea mays
agacgcttgtgaatcctggtcatcattcatggagaagaaggcagctactacagaggaaccccttctcgcgccgcggtccgagcacacggtcgcggcggaggccaagcggctgctgagcctggcggggccgctggtggccagctgcatcctgcagaacgtggtccagctggtttccgtgatgttcgtgggccacctcggcgagctgcccctcgccggcgcgtccctggccagctcgctcgccaacgtcaccggcttcagcctcctcgtgggcatggcgagcgcgctggacacgctgtgcgggcaggccttcggagcgaggcagtacggcctgctcggcctctacaagcagcgggccatgctggtgctggcgctcgcctgcgtcccgatcgccgcggtctgggccaacgccgggcggatcctcatcctcctcggccaggaccgcgacatcgccgcggaggccggcgcctactcccggtggctcatactgtccctggtcccctacgtcccgctcgcgtgccacgtccggttcctgcagacgcagagcatcgtcgtgccggtgatggccagctccggcgccaccgcgctgggccacgtgctggtgtgctgggcgctggtgttcaaggccggcatggggagcaaaggcgccgcgctgagcggtgccatctcctactccgtcaacctggccatgctggctctctacgtcaggctctccagcgcgtgcaagaggacgtggaccggattctccacggaggccttccgagaccttctccggttcaccgagctcgccgtcccgtcggcgatgatggtctgcttggagtggtggtcctttgaactgcttgtgcttctctctggtctgctgcccaatccgaagcttgaaacctcagtactgtcaatatgtctaaacactggcgccttgctgttcatggtgccgtatggtctttgcacagccataagcacacgtgtttcgaatgagcttggtgccggcgagcctcaagcagcgaggctagcagctcgagtggtgatgtgcatcgccctgtctgcaggcttgctgctcggctctaccatgattctcctgcgcagcttctggggctacatgtacagcaacgaacctgaagtcgtcacgtacattgctaggatgatgccggtcctggcgatttcgtttttcacggatgggctccacagttgtctatcaggagtgctgactgggtgcggtcggcagaagattggcgcgcgcgtcaatctcggtgcgtactacttggccggcattcccatggccgtgctgcttgcatttgtgcttcacctgaatggaatgggcctgtggcttggcatcgtttgtggcagcctcaccaagcttgtgctgctcatgtggatcacactgcggataaactgggagaaagaggcaaccaacgcaaaagaaacggtgttcagttcatctcttcccgtagcattatagagctgtatcctatatatgtgcagctggacgtaacaacaccacaacatgaa

SEQ ID NO: 153 - DNA, 1277 bp, Zea mays
tgacaaccagaatgaagtcagcaatgtcctcatttcaacacacaaacattatctatctctattattcatagacagtcatggcaccgagctgcggttgccatcttgttcacgtcactgccttcacaagcccttgctacttttttcagatctaaatctgaagcaacggccagaggaactcaggttggattggacagtggtccgttccattgggattgggtgggtctggggacctaggcagaccagatggccgggctattcaccgagcaggctgctgtgtacgccgcagcacggccggcgtacccgaaggatctgtttgccaagctctcggcgctcactgctcaccaccgccgcgcttgggacgtcggtactggcaatggccaggcagccatcggtgtcgcggagcactacgacagcgtggtggccacggacgtgtccgcggaacagctgcggcacgccacgccacaccccaaggtccggtacctgcacacccgcgacgccacgccgggggaggaggacctcgtcgccatgctgggcggcggcgaggccagcgtggacctcatcacggtggcacaggccgtgcactggttcgacctcccggcgttctacggcgccgcgcgccgcgtcctgcggaggcccggcggggtgatcgcggtctggggctacaactaccgcgtgagccccgtggaggacatgatggcgcgtttcttcagcaccacgctgccctactgggacccccgagctcggtattgcactgacggataccgggacctgccgttccccttcgaggacatcgggctcgggaaggaaggagagccggcgagcctcgacgtggagcacgagatgtcgttcgagggcctgattggcatgctgaggtcctggtcggcggtgacgacggcgaagcagcagggcgtggacctgctgggggcccgcgtcgtgaaagagctggaggaagggtggggtggggcggagctggtgcggaaggtcacatacaaggccttcctcctggcaggcaccccggggcccatggctgatgagtaatcaatgaggacctgtttggaaatatagttttctcgttctacagtatttcaatactatagtatgtcgtatgttataacataaaactgtagttttagcaaaactaaagtaaaatcaaagtagttcttcatacatagcactgtttggtagcatatagtttttggcttatataaataaggaagataagtttaaattcaaatagctacaacttatgatgggctgcatcatcggtaagacaagtt

SEQ ID NO: 154 - DNA, 1934 bp, Zea mays
acagcaacccagtgatcaattcaagcaacacaccgacgaagcaagcaaagccaagcggaagcggtcagcgtcagaatagtatggcggtgtccgcggccaagatggccgtcgccacggccgtctccttagccgtgcactggctcctccggtccttcctccaggcgcagcaccctgcgctgggcctgctcctcccgaccgtcgtcttcatcggcattgccgcgtctggcaatgccgcaggcgctgccaacgacgcgccgccggggccgccggccgtgccggtgttcggcaactggctgcaggtgggcaacgacctgaaccaccggttcctggcgcgcctgtccgcgcggtacgggcccgtctttcgcctccgcctcggcgtgcgcaacctggtggtcgtctccgacccgcgcctcgccacggaggtgctgcacacgcagggggtggagttcggctcccgcccccgcaacgtcgtcttcgacatcttcaccgccaacggcgccgacatggtgttcaccgagtacggcgaccactggcgccgcatgcgccgcgtcatgacgctgcccttcttcaccgcgcgcgtcgtgcagcagtacaggggcatgtgggaggccgagatggacgccgccgtctccgacgtcgcctccgcggcccagcgcgccgccggcctcgtcgtgcggcgcaggctgcagctcatgctctacaacatcatgtacgggatgatgttcgacgcgcgcttcggctccgtcgacgaccccatgttcgtggaggccaccaggttcaactccgagcgcagccgcctcgcgcagagcttcgactacaactacggcgacttcatccccgtcctgcgcccattcctgcgcggctacctcgccaggtgcaaggacctgcaggccaggcggctcgccttcttcaacagcaactacgtcgagaagaggaggaaggtcatggacgcgccgggggacaagggcaagctcaggtgcgccatcgaccacgtcctccaggcggagaagagcggcgagatcaccccggagaacgtcatctacatcgtcgagaacatcaacgtcgccgccatcgagaccacgctctggtccatcgagtgggcgctcgcggaggtcgtcaaccacccggcggtgcagcgcaaggtccgcgacgagatcaaggccgtcgtcgccgaccacgagcccatcacggagtccaccatccaccgcctcccctacctgcaggccgtcatcaaggagacgctgcgcctccactccccgatcccgctcctcgtcccgcacatgaacctcgaggaggccaagctcggcggctacaccatccccaagggctccaaggtggtggtcaacgcgtggtggctggccaacaatccggagctgtgggacaagcccgaggagttccggccggagcggttcctaggcgaggagaagagcgtggacgccaccgttggcgggaaggtggacttccgcttcctgccgttcggcgtgggccgccgcagctgccccgggatcatcctcgcgctgcccatcctcgcgctcatcgtcggcaagctcgtgcgcagcttccagatggtaccaccgcccggcgtggagaagctcgacgtcagcgagaaaggaggacagttcagcctgcacattgccaaccactccgtcatcgccttccaccccgtctctgcatgatagattgattgatagccaaccacgaatgctgcgcgtcgttttctgcatatcaatgttaccctacatacccagtcatttttttcgcttttatttactagccatttctcaggtataagtatctccaacaacaacagtgtgacctataaaaacatcctataatttgtttgaaaatgagtataatttataaaaattaaggcactaacaaatatacggctcccacagggaaagcggacagtccactgcggttcccaatttatt

SEQ ID NO: 155 - DNA, 895 bp, Zea mays
cacgcacttgcaaagaactcgagagcttgattcaatcataccctacactgccatggagtccagcaggatgcgctgctgcatgctgcttgttgtttccttggctctgctgctcccgctgggcatggccgcggactccatcggcagctactgctcaggaagcagctacgctggcagcagcaaggccgtggccaacatcaactccgtcctcgccgacctcgtcgcctcggcctcctccaccgggggctacgccacgtccaccgccggcaagggcaacaacagcatcatctacggcctcgcgcaatgccgcggcgacgtctccgccagcgactgcgcgtcctgccttgccgacgccgccaagcagctccccagcacctgcagctacagttccgacgcgaggatatggtacgactactgcttcatgcggtacgagaacgccaacttcttcgggcaggcggacacggacgcgggcgtgatcctggtgaacgtgcaggccatggacaacccgaaggcgttcgagaaggcggtggggaaggtgatgggcaaggcgacggcgcaggcgtcggcggcgggcagcgcggggctcgggcgggacaaggagcagtacacgccgttcgtgtccatctacgggctggcgcagtgcacgcgggacctcgcgccgctgacctgcgcgcagtgcctgtccacggcgctgtccaggttcggcgactactgcggcgcgcagcagggctgccagatcaactacagcagctgcagggtgcgctacgagatctaccccttctacttcccgctcgccggaaagggcggcggcctcgccaccaccgacatgacgaagaacaccaagatcgtcgtgcgtccttaattagcctgaagtgacttgtgtgccttaacgtagggt

SEQ ID NO: 156 - DNA, 307 bp, Sorghum bicolor
agatcgatcgagtcagctcaaggggtgaagcaggcatggctgcatccagattctacgtcacttgcgccctcctcctgatcggtgtcgtgctgctggggcagcaggggatagagggcgccgttgcctgcccccagtactgccttgaagtggactacgtgacctgcccgtcgtccggctccgagaagctcccggcgaggtgcaactgctgcctggcgcccaaaggctgcacgctccatctctccgacgggacgcagcagacttgctcttagctgggatggccgatctggaccaaagaccaacctgctta

SEQ ID NO: 157 - DNA, 2672 bp, Sorghum bicolor
ccacagatagagcagcaggacgggggcgatgccttcgctctcctgccacaacctcctcgacctcgccgcggccgacgaggtgcccctgccgtcgcccacgccgcttcgcctcccgcgcgtcatgtccgtcgcgtccccggcctcgcccacctcgccatccccggccgccccgccgcgccgcgtcatcgtctcccaccgcctcccgctccgcgcgtcgccggacccggccgcgccgttcgggttcaacttctccgtcgactccggcaccgtcgcgtaccagctccgctcggggctgcccgccaacgcgcccgtcctccacatcggcaccctcccagcggccgcggcggaggccgcctcagatgagttgtccaactacctgctggccaatttctcgtgcctgccggtgtaccttcccaccgacctccaccaccgcttctaccacggattctgcaagcactacctctggccgctcctccattacctgctcccgctgacgccgtcgtcgctcggcggcctcccgttccagcggacgctctaccactccttcctctcggcgaacagggccttcgccgaccgcctcaccgaggtgctgtctcccgacgaggacctcgtctggatccacgattaccacctcctcgcgctcccgaccttcctccgcaagcgcttcccgcgcgccaaggtcggattcttcctccactcgcccttcccctcgtcggagatcttccgcacaatccccgtgcgggatgacctcgtccgcgccctcctcaacgccgacctcgtcggcttccatacctttgactacgcgcgccacttcctgtccgcgtgctcgcggttgctcggcctcgactaccaatccaagcgcggttacatcggcatcgagtactacggccgcaccgtgacggtcaagatactccccgtcgggatcgacatgggccagctcagatcggtggtctcggcgccggagacggaggatgtggtgcggcgggtgaccgagacgtacaaggggcggcgcctcatggtcggcgtcgacgacgtcgatctgttcaaggggatcgggctcaagttcctggcgatggagcagctgctcgtagagcaccgggagctccgcggccgcgccgtgctcgtgcagatcgccaaccctgcgcgcagcgaggggcgcgacgtgcagggcgtgcaggacgaagccagggccatcagcgcccgggtcaatgcgcgtttcggcacccccggctacacgccgatcgtgctcatcgacggcccggtgacgcctcaggagaaggctgcctactacgcggccgccgagtgctgcgtcgtgagcgccgtgcgcgacgggctcaaccggattccctacatctacacggtgtgccggcaggagagcaccgcgctcggagacgacgcgcccaagcggagcgtcatcgtgctctccgagttcgtcggttgctccccgtccctgagcggcgcgatccgcgtcaacccctggagcgtggagtccgtcgcggaggccatgaacgccgcgctgcggatgtccgaggccgagcagcggctgcggcacgagaagcactacaagtacgtgagcacccacgacgtcgcctactgggcgcggtccttcgactcggacctgcagcgcgcctgcaaggaccatttctcgcgccggcattgggggatcgggttcggcatgagcttcaaggtggtggcccttggccccaatttccggcggctctccgtggagcacattgtcccgtcatatcgtaggacggagaaccggctgattctcctggactacgacggcaccgtgatgccagagaattccatcgacaggacgccgagcagtgaggtcatctctgtgttgaatcgtctgtgcgaggaccccaagaacagagtgttcatcgtgagcggtcgggggaaggacgagctcagcaggtggttcgccccctgcgagaagctgggcatcgccgcggagcacggttacttcacaaggtggagcagggacgcgccatgggagatctcaggattggccgccgacttcgactggaagaagaccgcggagcctgtgatgcagctgtacacggaggcaacagatggctcctacatcgagcacaaggagagcgccatcgtctggcaccaccacgaggcggatcctgacttcggttcctgccaggccaaggaactgctcgaccatctcgaaaacgtgctcgccaacgaacccgtggtggtgaagagaggccagcacatcgtcgaggttaacccccagggcatcagcaaaggcgtggtcgtggaaggcctcctgtcgtccatggtcaaaacggggaagccgccggacttcgtgctgtgcatcggcgacgaccggtcggacgaggacatgttcgagagcatcgtgtgcccatccaacagcagcctgaagctcccggccagcagcgaggtgttcgcgtgcacggtgggcaagaagccgagcatggccaaatactacctggacgacaccgtggatgtgatcaagatgctcgacggcctggccagcgcgccgtcgcagcggcctaggccggcggtgcagctcagggtgtcgttcgaaggttcgctctgaggaacacacacagcgctagcagtgaacatcgaggaagaataaccaatgatgatgatgaacatgattcagacagtgtggtgtaggattagctgca

SEQ ID NO: 158 - DNA, 1506 bp, Sorghum bicolor
tgctccaagccatacagtacacagtacacaccgatacacgggcgcgcgcctagtcaccaaagcgcatgcatatgcaatgcagagcgacactctggcctggaaagaagcgcgggatataaaaaggagatctagctgtatgggacaatagggaaaagcctagaaaaggatcgaacagcgggcgaccagttcggggcacccgcgctgtggtggtaggccaaggagtaaattcgcaaccaattcccaccagcggcagggatgggttgtgatttctgaagcgcctgggctataaggaagggtggtgttattttgactctcttgaagccaccctacccccaaagaaccactccatgggagactccaaagaaagagaacctcttccacggctgcttgatcttatcccggatgggaaacaatgtaaggggagggaagcacaaggcgcaggaagatcatcaaggaacacaggctttgggagcgaggaggacaagcagctagagctcaaactcggtcctccgggtctcatcgaagaagggacgacagcagcagcgtcaagagggatacagcgagagattccggctctctcgcttggttgcttcccacataaaccctcctccaagcctgcaataaacactactgcaactgggacaaagagggggttcttagacaccattgaggccaaaacagaaggtcgtgatgagcagaagcagcaggctggagctggatgtgggaaggaactagcactggacgagaagataacagccgcgagcgagagaaagaaaggattctgcccgccaacatcacagcatgcccctcctcctgctgctgcaactgtgcacaacagaccacacgcccagggaagaaggtcttcagctccggttgtcggttggcctccagtgagatccttcaggagaaatcttgctcatggcagttcatccaaacaatccattgagccacaaaatactgaagctagcatgaaggagaagcttgcctgcaagaagaatcctcttgtaaaaatcaacatggatggaatccccattggaaggaaagtagaccttggagcctatgacagctacgagaggctatcattgggcgtcaaagagcttttccatggttttcttgaagctcaaaaggatctatctagtgctggaagtacacagccaggggccactgaaaaaatattttctcaattattggatggatctggtgaatatactctagtttaccaagacaatgaaggagacaggatgctggtaggggatgtgccgtggaatgtatttgtgtcaactgctaaaaggctgagggttttgaggagctcagagctttcccatggtttgattgcagtagctcctagaagaggaccagattgctgaaagcctgaacagtgtcaaaattctatcatttggaatgtgagcaaactgaacccggaccattccccttctgtgatgtgatgatacctatttttttccctactaatctaatgagatgaactagcatttcagatgcatggag

SEQ ID NO: 159 - DNA, 908 bp, Sorghum bicolor
accattgtccaaagaaccagactaccagagcacgttcatatcccaatcccatccatcgtctagctcggaccaagctttggctttgggaccaaagttttggtggccaaccggccaaccagccgctgacgatggcggcgatgtggtggtgggcgccgctgccggcgtggctgagctccagcgcgctatggttcctcgtcgtcaacgcggttgtcgccgccgtcgccgtcctctccagggcacggccgccgctgccgtccccacgacgacgcgggtcaggggtcacggtcacgcggagggcgtcctccgcggtgatgcagcgcctccgctccttgtccatcttctccttcccctccgcctgcttcaacaccaccacgccgctcccgcaccctgaccctgacgccgcccaagaaacagaggagccggcggcggcgacgacgacgcccaagacaaccaagccgtccccgtccccacgcgcgctcccactcccgccgtcgccgctgtcgtcgtcagggcgcgtaccgccggcagacgacgacgagaccaccgggatgagcatggacgaggcctacgcgctggcgctgcaggcgcgccggcggccggagcgggagagggaggaggaggccaggaggtccgaggtggacgccaaggccgatgagttcatccgcggcttcaaggaggacctgcgccagcagcgcctcaactccatcttcaactacacccagatgctcaagcagcgggcactcggcggcgccgccgccgcccgcaggcagccagatcagctttgagtcacgtgatcgatttgttcatttatttaagatatattggtctgcgttttcagggagaccaaatcagttttgagttgctgttctagtgttctgtacatagacatagggctgctttcaacagat

SEQ ID NO: 160 - DNA, 1536 bp, Sorghum bicolor
cacgcagatctcgatcactaacgaccccatactaccatgggttctctcggcagcgccgcgcagcagccgcacgccgtgtgcctgccgtacccggcgcagggccacatcaccccgatgctcaacgtggcgaagctgctccacgcccggggcttccacgtcaccttcgtcaacaccgagtacaaccaggcgcgcctcgtccggacccgcggcgcggcggccgtggccggcctcccgggcttccgcttcgccaccatccccgacggcctgcccccgtcggatgacgacgacgtcacgcaggacatcccctcgctgtgcaagtccaccacggagacctgcctcgagcccttccgccgcctgctcgccgacctcaacgactccgcggccacgggctgccacccgcccgtcacctgcgtcgtctccgacgtcgtcatgggcttctccattgacgccgccaaggagctcggcctcccttacgtccagctctggaccgccagcgccatcagcttcctcggctaccagcactaccgccgcctcatgagccgtggcctcgctccgctcaaaagcgtcgagcagctgacgaacggattcctcgacacgccggtggaggacgtgccggggctacggaacatgaggttccgggacttcccgagcttcatccgcaccacggacccggacgagtacatggtgggctacgtcctccaggagaccgggcgctcggcgggggcgtcggccgtgatcgtcaacacactggacgagctcgagggcgaggcggtggcggccatggagtcgctgggcctggcgcgcaaggtgtacacgctgggcccgctcccgctgctggcgcgcgaggacccgcccaccccgcgctcctccatcagcctcagcctgtggaaggagcaggaggagtgcctgcggtggctggacggccgtgacccgggctccgtcgtctacgtcaacttcggcagcatcaccgtgatgaccaacgagcagctggtggagttcgcgtgggggctggccaacagcggcaggccgttcctgtggatcatccggcgcgacctcgtcaagggcgacaccgccgtgctgccgccggagttcctggccgcgacggccgaccgcgggctcatggccagctggtgcccgcagcaggcggtgctggaccacccggccgtggccgcgttcctcacgcacagcggatggaactccacgctggaggccatgtgcggcggcgtgccggtcatcagctggcccttcttcgccgaccagcagaccaactgccggtaccagtgcaacgagtggggcgtcgggatggagatcgacagcaacgtccggcgcgacgccgtggcgagcctcatcactgagctcatggacggggagcgggggaaggagatgaggagaaaggcactggaatggagggacatcgcggtcgaagtggccaagcccggcggcacgtctcaccggaattttgatgacctggttcgcaacgtgctcctgcccaagaactaggcgattagctccgtctttgcacggtgtttctgttag

SEQ ID NO: 161 - DNA, 1217 bp, Sorghum bicolor
gccgtctgcttctcatcacttccatggccgccgccgccgccgccgcctcggtggctccgtccggcccagtcccgttcacggaagtcgacgatggcacggtcccggagcacactcccaaggaggagttcggcgaccttgtggcctccctgccgcgcagggagcagtccatcctggagctgcgtctgtaccagggcttctggctgccggagcactgggtgcccggaaccatcgtgttccagcgccgcttcacgccgcgccccgacgacgtgatcctcgccagctaccccaagtgcggcacgacatggctcaaggcgctggccttcgccacggcggcgcgtacggcgtacccgccctctgacgccgggcacccgctccgccggatgaacccgcacgactgcatcccgttcatcgacgagatcttcgccggcggggaggacgcgaagctcgacgcgctcccgtcgccgcggctgatgaacacgcacctgccctacgccctgctcccggcgtccgtcgtcactgccaccggcgggtgcagggtcgcgtacgtgtgcagggaccccaaggacatggtggtctcgctctggcacttcctccgacgcaccaagccggacctctcgttcgccgacacgttcgagtccgtctgcgacggcaccgtggcggccggcccggtctgggaccacgtcctctcgtactggcgcgcgagcgtcgcgaccccggacagggcgctcttcctgaagtacgaggacctgctgcgggaccccgccggcaacgtgcggcggctcgccgagttcatgggctgcccgttctcggccgccgaggaggccgccggcaacgtcgcggccgtcgtggagctgtgcagcttcgacgagatgaagggactggaggtgaataggcctggtggtggcaccgcggggaagtaccgcgccatgccgcgcgacgcattcttccggaagggtgtcgccggggactgggcgaaccatatgacgccggagatggcggcgcggctggaccagatcttccgtgacaagctccaagggacggggctcgccttctcgtaatgcttaacaatcatttcgagacgtggacgcttttggatttgcgattctcttggcagttttgcgtgtctacatttccggaggaatatatggtaatgcaaatgtgtctacatgagtggaataaagagcgattttatattggtcacacgattcgatcaaatt

SEQ ID NO: 162 - DNA, 836 bp, Sorghum bicolor
agcccatcaacaccatgtcgacgcccgcgcttgcgacggctgccgagggagcgacgcgcatcatcctggtgcacggcacgggccatggcgggtggtgctggtaccgggtcgccacgctgctccgcgccgcgggacaccgcgtggacgcgccggacatggcggcgtctggcatcgactcgcggcagctccgcgacgtgcccaccttcgaggactacacgcggccgctgctcgacgcgctccgggcgctcctgccgggagagaaggcggtcctggtcggccacagcttcggcggcatgaacatcgcgctcgccgcggagatgttcccggagaaagtggctgccgccgtgtttgtcaccgcgttcctgccggactgcaccaacccacgctcgcacgtcatcgagaaggttatcgggtcagactggatggacaccgtcacggatgcagagcacgtcccaccctcggtgttcctggggcctgaattcctacgccacaagctctaccagctgagcccaccggagaactacacgctgtcccagagcctggcccgggtgagctccttctacgtgccagacctgcagagccagacgccgttcagcgagtccaggtacggcgccgtgaggaaggtgtacgtggtctgcaagcacgacctggccataaccgaggcgtaccagcacacgatgatcgccggctgccccgtggaggaggtgagggagatcgccgccgccgaccacatgcccatgttctccacaccggctgagctcgctgggcacctcgcccacgtcgccaacaagtacgcttgataccaaggttttcgtcacaaatgtaaacccgggtag

SEQ ID NO: 163 - DNA, 1634 bp, Sorghum bicolor
ggatccagctagcacacacatcgtcttgctataaaaagaggcatcagagaaagctcctgcagctccatccgaacctgtcacctgtgtgtgtgagtcctctgaacgtcttcagttcttcgttctactccaccaaattgccatttaccaagcacaaattaaccacgtcgcaaccgatggaggaggccgtggaggacatcgtcattgccggcgcgggcctcgccggcctcgcgacggcgctcgggttacacaggaaaggggtgcggtgcctggtgctggagtcgtcgccgacgctgcgcgcgtcagggttcgcgttcaacacgtggaccaacgccttccgcgccctcgatgccctcggcgttggggacaagatccgggagcaccatttgctctacgagaggatgattgccttctctgcagctacaggtgaagctgctgcagaagtaagcttaaagattcagggcaaaagcgggccacacgaaatccggtgcgtgaagcgggacttcctgctgcagacgctcgccaacgagctgcccgagggcaccatcaggtactcgtccaagcttgccgccatggaggaagacgacggcagcgtgaagaccctgcacttggcagatggttccatcataaaggccaaggtcgtgatagggtgcgacggcgtgaactcggtggtggccaagtggctgggcctcccgaagccgatcctctcgggccgctccgccaccaggggcctcgccgagtacccggcgggccacggcttcggcccggagatcctgcagttcatcggccatggcttccgctccggcgtgctcccctgctccgacacctccgtctactggaactacacctggtacccttccccggcggacggggacgccgaggagagcgtggccaagatgcggagccacgtggtcggcaagctgcggggcgccaagatcccggcggaggcgctggaggtgatcgagcggagcgagatgagcgacgtggcgtcgtcgccgctgcggttccggtccccgctggcgctggtccgcggaagcatcagccggggcggcgtgtgcgtggcgggcgacgcgctgcacccgatgacgccggagctcgggcagggcgggtgcgccgcgctcgaggacggcgtcgtcctggcccggtgccttggcgaggccttcagccacggccacggccacgacgagcaggatgaggggcggcggttcacggcggcgctggagaagtacgcggaggcgaggcggtggcgcagcatccagctgatcacggccgcctacgtcgtcggcttcatccagcagagcaacaacgccgtgatcaggttcctcagggacaagttcctgtctagactgctgtccaagacgctagtcgccatggcggactacgactgtggcacgctatgattctgccccattggagggatgggctgcaataaataaattaaagtaaaaacggtgaagaattacatggccgtcttgtatatcacatggaacacagagacttttgatcgaactacggtgatgtacggtgtgctgctacgtagtactagtacgtacacactcgttttagaggaaataataaatagtgataaatcggcagtgtcaacagttgactttgagttgtgattgtgaccggaattc

SEQ ID NO: 164 - DNA, 1629 bp, Sorghum bicolor
gtccactttctagctacgcacccgtccttccaatagcgcagcttcgccggcgccggcacgcagctagccatggccatcaaagatgagctgcagccgttgcacatcctcttcttcccattcctcgcgccagggcacctcatcccgatcgccgacatggccgcgctcttcgctgcccgaggcgtcaagtgcaccatcctcaccaccccggtgaacgcccaagtcatccgctccgcggtggaccacgccaacgacgcctcccgcggcaccgagggcgccctggccatcgacatcgccgtcgtgcctttccctgacgtcgggctgccacccggcgtcgagagcggcccggcccttaattccatggaggaccgcgaaaagttctcccacgccgcccagttactccgcgacccgttcgaccggttcttggtggagaatcgccccgacgccgtggtgagcgacagcttcttcgactggtcagtcgacgccgccgcggagcacggcgtcccgcggatagcgttcctcggcatcagcttgttcgcgcggtcctgcagcgacaccatgttgcgcaacaacccagtggaggccgcccccgacgacccggacgcgcccgtgctgcttccgggcctgccgcaccgcgtcgagctgaagcggagccagatgatggagcccaagaagcggccggagcactgggccttcttccagcgcgtcaacgccgcggaccagaggagctacggcgaggtgttcaacagcttccacgagctggagcctgactacttggagcactacaccacgacgctcgggcgccgcgcgtggctcgtcgggccggtcgcgctcgccagcaaggacgcggcgacgaggggcgccggcaacggtctctcgccggacgcggacggctgccagcagtggctcgacaccaagccggagggctcggtgctgtacgtgtccttcggcacgctgtcccatttctcgccgcccgagctgcgcgagctcgcacgcggcctcgacatgtccggcaagaacttcgtctgggtcatcaacggcggcgcggagacagaggaatcggaatggatgcccgatgggttcgcggagctgatggcgtgcggcgaccgtggcttcatcatccggggctgggcgccgcagatgctgatcctgacccacccggcagtgggcgggttcgtgacgcactgcgggtggaactcgacgctggaggccgtgagcgccggcgtgcctatggtgacgtggccacggtacgccgaccagttctacaacgagaagctggtggtggagctgctcaaggtcggtgtcggcgtggggtccacggactacgcgtcgaagctggagacgcggcgcgtgatcggcggcgaggtgatcgcggaggccatcggaagagtgatgggcgatggcgaggacgcggaggcaatacgggagaaggcccaggagctcgggaagaaggccaggcgcgcggtggcgaagggtgggtcatcttatgatgatgtcggacggttagtggacgagctgatggctcgcaggagctccgtcaatgtctgattggcccatcagtggaagcgagcttggagtgtccaatgaattgggatagcttggtgggaagagttgcctctctttgaaggtgtc

SEQ ID NO: 165 - DNA, 1726 bp, Sorghum bicolor
agaagaggcaacccattcattcatactcatgcgcgccacttctgtgcatgacgaataccagctagtcgatctgtgttccgtgtttgacattattattgctgcccaagattgggcggcgaaagtaattaatcaaggggacggaataagcttaagcagttgcgatcgatcggcggccatggccggaggcggcgacgatgcagaggagataacgctggagcacacgcccacgtggatcgtcgcctccgtatgttccatcatcgtcgtcatctccctgctcttcgagcgactgctccacctcctcggcaagaggctaacaaaagggcgccggaagccactgtacgaagccctcctcaaggtcaaagaagagctgatgctgctggggttcatctccctgctgctcaccgtgttccagggcaccacgcagaagatatgcgtccaggagagcgtgatgcgccacctcctgccctgctcgctccccgccgacgacaaggtcaccgcgcacttcatgatcgccggcggcggcacgaggaggctcctcgccggaggaggcgcctccagtgactactgcctcaagggcaaagttccaattctttcggtagaagctattcatcagttacacatatttatcttcgtcttggcagtcacgcatgtggttctcagtgctgttacagttattcttggaatcacacagacaagaaactggaaatattgggaggacaagatccagcaaaacaatgatagtgctcctcaaatgatcaaacatgtgcaagaattccaatttatcaaaagtcacttcagaggtcatggaaaaagatggggaatattcggttggctgcgctctttttttaaacaattctatgggtcagtcactgaggaggactacacaaccctacgacttggttttgttatgaaacactgcagggggcatccaaaattcaacttttacaattatatgaatagagcattggaagtggatttcaagaaagtcgttggcataagctggtacctttgggctatgctaatgatattcttgctactcaatgttcatggatggtacgtctacatttggctatcagtagccccattcattttgctacttgtgctcggaagtaagatggagcatattatcacggagttggctcttgaggttgcccaaaaacatacggcaatagaaggggttctagttgtaactccttcggatgaactcttttggttccatcggcctaaactagttcttctcttgattcatatcatcttgttccaaaatgcatttgaaattgcactcttcttctggttgctggtcacgtatgggtttaattcttgcattatgggagaaccagcatatgctattattcgtgtggtgataagtgtcatcagccaactcttatgtggatacagcaccctacctctctacgctcttatctcccaaatgggaagttcttttaagaaggccattttcgatgaaaatatctccgaaggcctcaccaactgggcagaaaatgctaggaggcgtaatagaatggcaacaacaagtgtcagtgacaattcacctattggtgagggaattcaaatgtcaaataaggcacagagagaatcagcaatggaacaaggaactgcaaggttgatctaatgtggatgtacaagctagtgcacaatgtacatatactaggtaggtaagcgcacttcgccgcacccatagtggctgctggctccaatagacatctct

SEQ ID NO: 166 - DNA, 675 bp, Sorghum bicolor
tatttcccatcatctgtcggagcacgtaaatcggctgcgggcgatcgaccggcgacgccatgtccaagcaaaagactgtgatcaggctgggcgtacccaacgccaagaaccggtctaaagccatgcagctcgcatccaaagctgtcggagtgaactcggtggccatcgccggcgaagccaaggaccagctggaggtggtaggagaaagcgtcgacatcacctgtctgatcaatcacctgcgcaagaaggtctgccgcgccgacatcgtcgtggtggaggaagtgaaggacaagaagaaggaggaggaggagaagaagaagaaggaggaagaagccaagaagaagaaggcggaggaagataagaagaaggcggaggaagcaaggaagaaggcggaagaagagttcaagaagctctgggcggcgtgcccgccgccgccgtacaacggtggttattatagttaccccgggccgccggcgacgtttgtatgcgaggaacagccagcagcaggctgccacatcatgtgaactggagctgcgtacttaagatggattttgcccggcgtgtatatgcttaatatgtttgtgattttggttctgaacttctgacctctccgtgaatcgtgctgggcgcatgtgcacaaaccatcactggcagttggcagaaatgaaagcaaac

SEQ ID NO: 167 - DNA, 4898 bp, Sorghum bicolor
gctactcccactcgtactcaggcacacgggatggcgctcccatggtggctcgccaccacggcgtgcgccgcgccgccacccggcccgggctccttcgccgacgcgctcgcgttcctcttcctctccccgtgcccgcagcgcgtgctcctcgccgccgccgacctcgcgttcctcgtcgcctgcctcgtcctcctcgcccgacgacgccttcgccttcgcaggggacagggacacccggcgccggcggctgctcctgctcccgctcccgctcccgaacgcgaggcgctgctgcagcagaagccgaaccatcatccttcgccgccgctctccctccgccacgtgctcgcgctcggggcctccgcggtcttcgcggcggcgtccgcggtcctcctcgcgctcgcgctcctcctcctgccgagcgcgccgtggcgcgccgcggagggagccttcctcgccgtccacgccgtcgcgcacggcgtggctgcctggaccgtcgccgcctcttcgcggagagcaggagctgctgcccacctccgcgtgttctggctcgccaccgccctcggcgccgcgctcttcgctgcctcggcggtggttcgcggcgcggacggctcgctgctcttccccgacgacatcctcgccttcgctgctctgctcgtctcgctgcctctgccatacatagcggtcaccactggcttcaccggccatggcaccaccagggcagcacaagacgctgagcccgagcacaacgtcccggaggcgcctccctcctcgccgtacgccgccgcttcgttcctctcgcgggcgacgttcagctggatcaactctctcatcaacaagggctacgcagcagaatccttaaaaaccgaagacgtgcctccggtctctgccggccaccgcgccgaggcagcgcacgcgctgttcatgtcgaattggccggcgacgtcgccggcgtctcggcacccggtcggcgtggcactctggctgtctttctggccgcagctcgtgctgactgcgtttcttggcctcgcgcgcctgggtgccatgtacgtcggcccatcactcatcgaccggttcgtcgagttcatccgccgcggcgggacaccatgggagggtctccggctcgttctcatcctgctcgccggcaaggccgtccagacgctggcctcgcaccattacagcttccagggccagcttctgggcatgcgcatccgcggcgcgctgcagacggcgctgtaccgcaagtcgctgcggctcaccgccggtgcccggcgagcgcacggcgccggcgccatcgtgaactacatgcaggtggacgctgggatcgtgtcctacgccatgcacgggctccacgggctgtggctgatgccgctgcagatagtggtggcgttgctcctcctgtacgcctacctcggccccgccgtgctcatgacgctcgccgtgatcaccgcggtgaccgtggtcaccgcgttcgcgaacaagctcaacctggcgtatcagctcaagttccttggcgtccgcgacaggcgtgtgaaggccatcaccgagatgctcagtaacatgcgtgtcatcaagctgcaggcatgggaggacaccttcggcggcaaggttcgtgacatccggcgagaggagcttgggtggctggcgaagaccatgctcttcatgtgtgccaacacgctggtgttctcgagcggtccgctcgccatgacggtgctcgtgttcgggacctacctcgccgccggtgggcagctcgacgccggcaaggtgttcacggccacggcgttcttcggcatgctggaaagtcccatgcggaacttcccgcagacgattgtcatgtccatgcaggcgtttgtgtcgctggataggctgaacaagttcctgaccgacgccgagatcgacgccgcggccgtggagcgcatcgagagcggcggcgctgaggacacggtggccgtcaaggtggaaggcggggtgttcgcttgggatgtgccagccggcggggagatgaagggcaacagcgacaggaggtccagccatgccgtggcagagaatggccaaggaaacggagcggagttggtgacggtgctgaggggcattgatgtggtggtgaggaggggtgagcttacggcggtggtcgggaaagtgggctccggcaagtcgtcgctgctgtcctgcttcatgggtgagatgcacaagctctccggcaaggttagcatatgtggaagcacagcatatgtttctcagacctcttggatccgaaatggaaccattcaagagaacattttatttggaaagccaatgcgtccggagagatattcagaaatcataaatgcttgctgcctagaaaaggatttggaaatgatggagtttggtgaccagactgaaataggtgagcgagggatcaatctcagtggaggccagaaacagcgcatccagcttgcaagagcagtttatcaagactgtgatatatatcttcttgatgacatatttagcgcagttgatgctcatactggatcagctattttcatggaatgtctgaagggtatactcaagaataagaccgtgttgcttgttactcaccaagtggacttcttgcaaaatgtggatactataattgtaatgaatgatgggttagtcatccagtcagggatctatcgtgagttactagcatcatgctcagaattttcggatcttgttgctgctcatcatagttcaatggagacagcagggggacaatgttttcatgttcagaacacagagagccctcaggcttccaatggatctgtagattccccatctttggcatcgaaatccaatgctgaaaatggtgaatcggttggcactgcaacaaacaaagaagcaggttcttctaagctgatccaggaagaggaaaaagagagtggccgagtaagctggcgtgtttacaagctatatatgacagaggcctggggatggtggggagttgtgatcattttagctgtgtcactgctgtcagagggctccagtatggctagtgactactggttatcatacgagacatcaggaggccctgtgtttgacacttccatatttcttggtgtttatgtttcgatagttgctacgacaattatattggaaatggtcgccactcttattgtgacattcttggggcttcaatcagcacaggcctttttcaacaagatgtttgacagcattctacgagcaccaatgtcattttttgacaccactccttcaggaaggatcctaagccgggcatcatcggaccaatctaagattgatactaatcttgtgttctatgttggttttgccacatccatgtgcatttcagtggttaccaacattgctattacttgccaagttgcatggccgtcagtaattgcagtacttcctctactgcttttgaacatctggtaccggaatcgttatattgcgacatctcgagagctttctcgtcttcaaggagtaacaagggcgccaattattgatcactttacagaaacctttttgggtgccccaactgtaaggtgcttcagaaaggaggatgagttctaccagacaaacctggacaggatcaattcgaatttacgaatgtcatttcataattgtgcagctaatgagtggcttggatttcgcctggagctaattggcacacttattttgtctataactgcttttctcatgatcagcttgcctagcaatttcatcaagaaagaatttgtcggcatgtccctttcctatggtctttctctcaattccttggtgtactacgcaatttccataagctgtatgatcgaaaatgatatggtagccttagagagggtgcatcagtacagtactctcccttctgaggcagcatgggaagttgccgactgtcttcccacaccagattggcccatccgaggagatatcgatgtgaaagatctgaaggttcgatatcgtcaaaacacaccactaatcttgaaaggtattactgttagtattaagagtggagaaaagattggagttgtgggaaggactggcagtgggaagtcgactttagtgcaggctttattcaggattttggagcctgcagaaggccatatcatcatcgatggtgtcaatatctgcactttggggcttcgtgatctgaggtctcgctttggtgtgattcctcaagagcctgtgctctttgaaggaactgtaaggagcaacatagacccaacagggcggtattccgaagccgagatatggcaggcccttgagcgttgccagctaaaggatatagtagcctcaaaaccagagaagcttgatgcactagtcgccgacatgggggagaactggagtgtagggcagaagcagctcctttgcttcggccgagttatactgaaacgcagccggatcctcttcatggacgaggcgacagcttctgttgattctcaaacagatgcggccatccagaagatcatccgtgaggaattcaccgaatgtaccatcatcagcattgcacatcggataccgactgttatggacagcgatcgagttctggtgttggactcaggtctcgtggcagaattcgatgcaccctccaaattgatggggaggccatcactctttggtgcgatggttcaggagtatgcaagtcgctcttctagcttgaaggaaaccgttggatgagaccacatttcatggcaaaagacgacgacagtataggagaaagtttaggcatacgcataggcatacgcatagcatctaacgaaaacgaaaaataaattataggagtttctgtaagctttattcgctacaacatgtcttatcttcaatagaactggactatttggtttacatttccaccaattttgtatgtgatgaaagcttagagcaactacaggaagtttgtgtaatttacttgctaaaccaacgactag

SEQ ID NO: 168 - DNA, 608 bp, Sorghum bicolor
cgacaatgtgtggcggagccatcatcgccgacttcgtccccgccggcggccgtcgccaggcaaccgacgacaccatctccgcctcctccctcctctccggcgaggaccagcatctggaggagctcggcagcagggtgccggcgccggggcgcaagacggcgtaccgcgggatccggcgccgtccctggggccggtgggcggcggagatccgcgacccgcggaagggcgcgcgcgtctggctcggcacctacgccaccccggaggacgccgcgcgcgcctacgacgccgcggcgcgcgagatccgcggggccaaggccaagctcaacttcccgcccgccgtcggcgctggcgccggcgccggcgcgcgcgagccggcggccaagaggcgccggacgtcgtcgtccgcggcggccgaggagagctcgggctcgtctccggcagcgacgacgaccgtcgtggcgggcgtcggaggcggcggaggaggagaggagacgctgcgtgactgcatgtccgggctggaggccttcctggggctgcaggaggaagcggccgacgagggtggcgacgccgaggcgtgggacgccgtcgacctcatgttcgcgtagtag

SEQ ID NO: 169 - DNA, 332 bp, Sorghum bicolor
cggcaatggctgatgaggagaagaagcaccaccaccacctgttccaccgccacaagcaggacggcgaggaggaggcgagcaccggcgaggtggactacgagaagaaggagaagcaccacaagcacctggagcagctcggcgggctcggcgccatcgccgccggcgcatacgctattcacgagaagcacaaggcgaagaaggagcccgagagcgcgcacgggcacaaggtgaaggaggaggtggcggcggtggcggccctgggcgcggccgggttcgcgttccacgagcaccaccagaagaaggacgccaagaagcagggccagagctgatga

SEQ ID NO: 170 - DNA, 1603 bp, Sorghum bicolor
attgcgaagagccgaagacagcaaacaatggggagcacgagcaccaccaccacctcatcttcctcctctgctacccgcggcggcggcgcacacgtgctgctcctgccgtacccaggcgcgcagggccacacgaacccgctgctcgagttcggccgccgcctcgcctaccacggcttccaccccacgctcgtcacttcccggtacgtgctctccaccaccccgccaccaggtgagcccttcagggtggccgccatctccgacggcttcgacgacggcggcgcggccgcgtgctccgacgttgaagtgtactggcgccagctcgaggccgtcggctcggagacgctggcggagctgatccgctccgaggctgccgagggtcgccccgtgcgcgtgctggtctacgacccgcacctgccgtgggcgcggcgcgtggcgaaggcggctggggtgccgaccgcggcgttcctgtcgcagccttgcgccgtcgacgtcgtctacggggaggtgtgggcggggcggctgccactgccggtggtggacgggaaagagctgtttgcgcgcgggttgctgggtgtggagctcgggcccgacgaggtgccgccgttcgcggcgaagccggactggtgccctgtgttccttgaggcgtgcacgcggcagttcgaggggctggaggacgccgacgacgtgctcgtcaactcattccacgagatcgaacccaaggaggcagattatatggcactaacgtggcgtgcaaagacaataggcccaaccttgccatcattttatcttgatgatgaccgcttgccgttgaacaagagttacggtttcaacctcttcaacagcagcgagtcttgtctggattggcttgacaagcagcttccatgttctgtagttcttgtatcctatggtactgtctctgattatgatgaagcacagttagaagagctgggcaatggattgtacaattctggcaaaccattcatttgggttgtgaggtcaaacgaagaacacaaattgtccaatgaacttcgtgccaagtgcaaggaacgtggccttatcgtttcttggtgctcccagctcgaagttctagcacataaagccacaggttgtttcttcacacattgcggatggaactcgacgctggaagcagtagttaatggtgtgccaatggtggcaataccacactgggcagaccagccgaccatatcaaaatatatggagagcatatggggattgggtgtccgggtgcgcaaggatgagaaaggcttggtgacgagagacgaggtggaaaggtgcatcaaggatgttatggatggggatagaaaggataattataggatgaacgccactatgtggatgcaaaaggccaaggaagccatgcagaatggagggagctcggacaagaatgtttgtgaattcgtggcgaagtattcatcaaattagttttcaaagttaatgcattagttacttaattcctatatctttgtggattgtatgtgttactgtatattacattatgtctggggttataggtgctactttgtgatacatacatagaaaatgcttctgtgctctagtgcaataatgaaatagggatcttcca

SEQ ID NO: 171 - DNA, 334 bp, Sorghum bicolor
caggcagcttacaaggagaaagacaacttgctaagagattgcgatggcgtccatgatgatgggaggagacttggtggaggcgtacgtgctcaagaacgcgtacaaggagaaactccggcgcatggaggccgccgaggagacgaagaagggcaagctgggccccgtggcggagaagaaggtctcgggcggcggaagcaggggaggaggaggcctgtttgggctccttaagaagaaggtgcacccaaaagcggcggccgcgtctcccatggagaccaccagcgctgaagaagcaacctcttcttgattcagctctgtgtccgtccaacaaatttag

SEQ ID NO: 172 - DNA, 722 bp, Sorghum bicolor
gccagggatacttcatggactatggcaaaccgctcgtgaagagtgagctcaggctctccctgaatcctcctccttgcgcccaagacaacaaccccaccactcccaccggagccgcctccgatggctcgtcgtcgccatcctgcgcgtcggccgtcgtcgccctgtccttcctcgggctcaacagcgtcgtagccatctaccgctcgagacacgacccccggtccatactgtttgtcaccgtctgcttcttctgcgtcgtccttctcttccacctgcttcgtgtgttcgagagactgccgccgggatcgcccaggaggttgccggtgaaggcggccgtatgggccttgacgaccaccctgacggtgatgttctccggcagagttgccccgttgatgcctgcgcctgtcgccgccgtcgtgtggtcgatggccgcggtgaccatcctcgcgggcttctacttgttcttcgtgtgcccggacgccgcctccaccgccgccgacgagaaaccggcctgcaaggttgccgaaggcccgtgaattgtttatgtatgtgcttttgtatttgttattattacaaatatcttgtaaggaacatatcataccaacggcacaatcggagctggttcgctatattaggcattgctcgaacggccaaaacacgctcgcaggttcgcacgtcctcagacgtttccgcgactatcctcgaactttctctcctcctgt

SEQ ID NO: 173 - DNA, 989 bp, Triticum aestivum
ggcgcatggcctcgacaacggcggtgccggaggtggcgctgcggtccggcgacgcgaggcccatgccggccatcggcatgggcaccgccaagttaccggtggtgccggagaccacggtgaaggccgtgctggaggccgtggtggtgggctaccgccacttcgacacggcctccatgtacgcgacggagcggcccctgggcgaggccctcgcggaggcggtgcgccgcgggctcctggcgtcccgggaggaggtgttcgtcacgtccaagctctggtgcacgcagtgccacccgcacctcgtgctcccgtccctccgggagagcctccagaacctgcagatggagtacgtggacctgtacctgatccactggccgataagcctgaagcccgggccggcggttttcccggtgaagcgggaggacgccgtcccgttcgacttcgcgggcgtgtggcgcgcgatggaggagtgccaccgcctcgggctcgccaaggccatcggcgtcagcaacttcaccaccagccacctccacaagctcctcgccgctgccaccgtccctcctgcagtcaaccaggtggagatgaacccggtctggcagcagaggaagctgagggagtactgcgccgagaagggcatccacgtcgcggcctactcgccgttgggagggcagaactggtccggcgacggcaacgccgtcctggactccgaggtgctcgcggagatcgccaaggctagaggaaagaccgttgcacaggtagcactgaggtggatttacgagcaaggggcgaccccgatcgtcaagagcttcagcaaggagaggctcaaggagaacctcgggatcttcgactgggggctcaccgacgacgacctgcgcaagatcggccagattccgcagaagaagatcgtcagagctgaaaccgtgctgttctcggcggagggcgagttcacgtcggctgacctcgcggagatggaaattgtcgaggaataataa

SEQ ID NO: 174 - DNA, 414 bp, Triticum aestivum
tggtttcgtgtgatcaagagctcgggtatggagttggagatggtgagccagcacggggcgctgctgaaggtggggctgttcgtgctggtgcaggcgctggtgtacctcatcctcgcccagtcctcctccgtcttctccaccaccaagaccctctgtctgcccccggcgcgctccctcagcgcccgccgcatggtcgcgctgctctccgacctgccgctgccgctcggcggcgagccctcgccccgcgccgccttcgtggagccgccgtcgcccgtacccctcgcccaccagaagaaggattagttattaaccaagcgcgactggcggcagggacacggaccgagctagcaagcgatcgtttccgagctactagtagtagtactcggtgcgtgctgtaggagctattcacgccat

SEQ ID NO: 175 - DNA, 707 bp, Triticum aestivum
cctcacgaagagctaagcaatcgcattgcatccgatcaccaatccattcctagcttactagctagctgatcctaatggcgagcagcaccgctctctcctgcctggccgcgctcctgctcctcgcggccgccgcggcgcccgcgtcggctgcggaggagacccggctgcgggtgtactggcacgacgtcgtgagcggcgggccgaacgcgagggtggtgcaggtggcgcaggcgccgtcctccaacgcctccgccacgggctttggcactgtgctcgtcatcgacgacccgctcaccgaggggcccaacctgacgtcgaggctcctcggccgcgcgcaaggcatgtacatcagcgccggcaaggacagcctgtcgctgctcatggccatgaacttcgtcttcgtcgacggcgcctacaacgggagcagcatcgccatcatcgggcccaatcaggcggaccgggccgtcagggagatgcccgtcgtcggcggcaccggcgtctttcggttcgcgcgcggctactgccagttgcggacccactggttcgacgccaagaccggcgacgccaccgtcgagtacaagatccatctccgccacgactgatgcattgtcagctggactaataataaacttgttgttcctacacatatggtttcctgatttgaaccaagcttattttaaatttcgagggtatgtgcatgtgtcgta

SEQ ID NO: 176 - DNA, 800 bp, Triticum aestivum
cacacatgtcgtcatcctcctctgccccagcggccgccgtgccgacgtcgacccgcctcatcctggtgcacggcacgggccacggcgggtggtgctggtacaaggtggccaccctcctccgcgccgcggggcaccgcgtcgacgcgccggacctcgcggcatgcggctccgacgcgcgccggctgagcgacgcgcccaccttcgaggactacacgcgccccctgctcgacgcgctccgggacctcccggacggcgagcgggcggtgctcgtgggccacagcttcggcggcatgagcatcgcgctcgccgccgaggagttccccgacaaggtcgcggccgccgtgttcctcaccgccttcatgcccgactgcgacggcccgcgcacccgcgtcatcgaggaggttcccgtgtccgactggatggacagcgtggtcgacgaggagcacgccccgccgtcggtgttcctcggccccgagttcgtgcgccggaagctctaccagctgacttccgaggaggactacacgctgtgccagagcctggcgcgggtgagctcctactacgtggccgacaacaacaacaagggggggttcaccgccgcccggtatggcgcggtgaccaaggtctacgtgatcgccaagcaggacctggccatggtcgaggagtaccagaggcagatgatcgcaggcatccccgtggctgaggtgagggagatggctgatgccgaccacatggccatgctctccgcgccggaggaactggcgggccacctcgccgacatcgccaacaactacacttaataa

SEQ ID NO: 177 - DNA, 771 bp, Triticum aestivum
tgcacacgcaaagattccatgggagcgaagctttcctgcttctccaaccgcggaggcagcctctcgcagcagccacaccagccggcgcctgttagggtcattgccgccgacggatcgctgaaggagctcccggccagcccacgcgtcaccgtctccaacgtgctcggcggcagcgccgcgtccttcttcgtgtgcagctccgacgcgctctacttcgaccagagccctccggcgctggcatccggggaggtactccagtcggggcagatatacttcgtgctcccggcggcgttgctcgggcggccgctatccagcgccgagatggcctcgcttgcggtgcgagcgagctcggcgatcgcggccaagaagccgcagcggaggcgggggcgcctcagcggcgggaggaagaaggtgcgcgtcatgccgatgcacgaggaggtggaagacggcgaggatgttctgctgaacgagaagcttaacgagcggacgctcggggagttcgccgtgtcgccgatgagcccagagaagatcggcgtggtggcggcacggtcgcggctgaagatgaagctgaagcgcgctctgagtatcattcaagaggttgctgagtgaagcatttctctaaaagataaatactagtggtgttttttttttagtttttggttctgtttgaagccatatttaggtttaagcccaaatatttaattggtttagttgatttaggataggaagaacatgtattctgggaaagggtatgtgaatatgtcccatggt

SEQ ID NO: 178 - DNA, 1596 bp, Triticum aestivum
atttaggagcaccgcagaaacaacaatggagatgggtagcttccccttcttctacgtcgccgccatcacctttctcaccgcccttttgctccgctccttcctcaccaagaagcggcgacggctgccacccggcccggcgctggcggtcccgttccttggccacctccccttcctcaagaagccgctgcacgccacgctcgcgcgcctcgccgcgcgccacggcccggtcttctccctccgcctcggctcgcgccccgccgtcgtcgtcacctcggcggagctcgccagggagtgcttctcctccgacctcgacgccacgatcgccaaccgcccccacttcccgtccgtgcgggaggtctccttcgactacaccgtgctcaccctcgccaactacggcgcccactggcgcgccgcgcgccgcgtcgccgtcgtgcacctcctctccgcgcgccgcgtcgacctcatgtacgacgccgtcgtcgcccgcgagctgcgcgccctggtgcgccgcctcgcgcgccttaccgccggcggtgccgcggccagggtggagctgaagcggcggctgttcgacctctcccacagcgtcctcatggaggccctcgcgcggagcaggaacacctactccgacgacggagcggacatgtcgcaggaggcgcgggagatgaaggacgttgtggacgccatcgtgccgctcgtcggtgtcgccaacctgtgggactacctaccggtgctacgctggttcgactggcgaggcgtcgggcggcagctggcggacgtaacgagccggaggaacgccttcatatacaagctcatcgacagggagaggcggaagcagcaggccgccgccgacaagcaggaggaggagcagggcatgatcggcgtcatgctctcgctgcagaagtcagagcccgacctctacacggacaatttcatcgccgccctcgtcgccaatcttcttggcgtcgggacagagacgacgtcgacgacgacggaatgggcgatggcgctcctgctgaaccacccggcggtgctaaagaaggcacaggaagagatcgacgcgcacctcagcggcgagccgagccgcctcctcgacaagaaggacctgccccaccttccttacctccactgcatcatcaatgagacgatgcggctgtgcccggccgcgccgctgctgctaccacacgaggccgccgccgactgccagctccacgggtacgacgtcgccgcgggcaccatcgtgctcgtcaacgcgtacgccatccaccgcgacccggctgagtggggaccggcgcccgaggagttcaggccggagaggttcgagcatggcggcgccgaggggaagctcatgatgtccttcgggatgggaaggcgcaagtgccccggggagagcctcgccatgaggaccatgggtatggttcttggcacgctcatccagtgcttcgattggaaaagggtcggggatgaagaggtcgacatggccgccagttccgggatcgtcatgttcaaggccgtcgctctggaagctctctgcacaccgcgagccggcatggaaactcttcttcacaagctctaaactgaaaatggttaaaggaa

SEQ ID NO: 179 - DNA, 348 bp, Triticum aestivum
taagtcagcagggtttgttcatcgacggtcgttcctttcgtcgtcgccggcatgcagcggagcagctcgttcgggacgtcgtgggcggaccagtgggacaccggcgccgacccgagcccgcgggcgcgcggcggcggcaacggtggcggcgacggcaagaagggcggcgtggagaagaccaaggcggccgcggccaccgggctgaagaaggtcaaggccggcaccgcgcaggggttccagtggatcaaggacaagtaccagaagaagagcgccggcaagagcggcaagcagggcggcggctccgaggtggccgccgggtactgaccggtcatctgagacgtttggata

SEQ ID NO: 180 - DNA, 923 bp, Triticum aestivum
caactaggagctaaccagccagtcaggtgaggagagcatggcaagctaccaccgggtccacccggtgatcgtcgacggcgcgccgcccccggtgccagagcaaaacaaggataagctgccacggccacccagcgccgactatggcgaccggctgccgatcaccgccccggcacctggcgcggcggccccgctgcgcgcgccgcggcggaagcggcacaacaggtgctgccggtgcgtgtgctgcacgctgctggtgctgatcgtgctcatcgtcgcgctcggcgccacggcggggatcctctacgccgtgttccggcccaagatccccacgttccgcgtggagcgcctcacggccacccggttcgacgtgaacaccacctccatgacggtgtccgacgcgttcgaggtgcaggtggtcgccgagaacccgaaccggcgcatcggggtgtactacgacggcggctgggtcgccgcctcgttcaacggcacggagctgtgccgcggtgcgttcccggcgctctaccagggccaccgcagcacggtgcggccgctgatcacgctccagggggagacgaggctcgacagcgccgtggccgcgcagctggcgcagcagcggcaggccgggttcgtgccgctcacggtcaccgcgcgcgtgccgatccggatcaagtttggcgccctcaagctgtggaagatgacggggaaggccacgtgtagcctggtggtggacagcctcgaggccgggacgcggctccgcatccgctccaacagctgcaccttcaagctcaagcctaattagatcattctcaaaccgtttgagccgtgcacggattgtgcatatatacgtgtgtcttgtatgtaggattaccgaggtctcgtccccgttcctgtcgatctatattgattgagatcgatcggcagat

SEQ ID NO: 181 - DNA, 1823 bp, Triticum aestivum
cagcttgacaaactccactagcacttttgctgccacagccgatcagccatgaccctctccggcagcggcgatagccagagcggctccgcgagggcgcacttcgtgctggtaccgatgatggctcagggccacaccatccccatgaccgacatggcacgcctgctggcagagcatggcgcgcaggtcagcttcatcaccacgccggtaaacgccgctaggttggagggcttcgccgctgacgtgaaggcggcaggcctggctgttcagctcgtggagctccacttcccggctgcagagttcggcctaccggatggatgcgagaacctcgacatgatccaatcaaagaatttgttcctgaacttcatggaggcctgtgctgcgcttcaggagccgctcatggcgtacctccgtgagcagcagcgctcgcctcctagctgcatcatatctgacatgatgcactggtggaccggcgacattgcaagggagctcggcatcccaaggctcacctttagtggcttttgtggcttctcgtcccttgtcaggtacatcatttttcacaacaatgtattggagcatatcacagatgacaatgagctcatcacgatcccagggtttcctacaccgctagagatgatgaaggctaaattacctggaaccctttctgttccgggtatggagcaaattcgtgagaagatgtttgaagaggagctgagatgcgatggtgagatcactaatagcttcaaagagctcgagacattttacattgaatcctttgagcagataacaaggaagaaggtctggacggtcgggccaatgtgcctgtgccaccgaaacaggaacacaatggccgctaggggtaacaaggcggcaatggacgatgcacagtgcttgcaatggcttgattcaaggaagccaggctcagtgatctttgtaagctttggcagcctcgcttgcactacacctcaacaacttgttgagctgggactgggactcgaagcctccaagaaaccgtttatttgggtgatcaaagcaggacctaagtttccagaagttgaggaatggctcgcagatgggttcgaggagcgtgtcaaagatagaggtatgatcataaggggctgggcgccacaggtgatgatcctgtggcaccaagccattggaggatttgtgacgcactgtgggtggaactcaataatagagggcatctgtgcaggtgtgcccatgatcacttggccgcactttgcagagcagtttttgaatgagaagctggtggtggatgtgctgaaaatcggggtggaggttggcgtgaaaggagttacacagtggggaagtgaaaaacaagaggttatggttacacgagatgccgtggagacggcagtgaacaccctgatggacgagggggaggctgcagaggagctgagggtgagagcaaaagactgcgccattaaggcgaggagggcttttgataaggaaggctcttcctataacaacgtaaggctgttaattcaagaaatgggaaacaagacgaatgcatgtggttgatacagacggtaataagctcgccttttctgtgtaaacatgaagtgaaagatcctagaagacatatatcatcatatagaattttgtaccaggctcacaggtgattatttggagattagagatgatccaaatgaaggcaatatcaattgtcttcttttgtacgctcttttatggcaatccaccacataacgactacacagtctgctcttctagatggttacgctctcacttgcattttgctaccgctgttgcacaactagccatggttgtcaaagcataggacaatg

SEQ ID NO: 182 - DNA, 457 bp, Triticum aestivum
ggcagcagcaagaatagttgaggagaaggagaggaggagctgataaggcatggcgtccatgatgggaggagacttcgtggaggcctacgtgctcaggaacgcctacaaggagaagctgaggcgcatggaccaagccgaagctgcggcggcgcaaagagcaccaaggacgccgccggtgccgctggagagaagaagaaggctgctgctggcggcggtggtggtgcgagcagcaggggaggcttctttggcctcgtgaagaagaaggtgcaccccaaacccaaagcagcagccgcggccacttcctcttgattatactactgtattcgccatgccaccaagttgtaagccgcagctttcttctagctaggagcgtatgtgtgtgtatgtttgttctttcgattagcttctctgaggccaaagaaactttgtgttggaggagtgtgtaagtcactggctg

SEQ ID NO: 183 - DNA, 417 bp, Triticum aestivum
cgctcgaatcattagctagcagcctcgaatcatcaccatggcgtctgccggccgccgtcccacggtgctcatgcagatcgctctcttcttcgtcgtcgcggcggtcatcatgaacagctccgtctgccttggagccgccgccggcgacgccactgcaggctctggtgctttcgaccctaaccgccctgctgtcccgtcgacgggtggtgctggtaaaccctacaccggccgtcggtgcctccctaagtaccgctgctacccaccggctggtggccaaccctaagtaagaagtaagatgcacccgcccgcgccgagaccccgtcccccaaaaataatgcaaggatcgatcgatatatatgtatatactatatgcatgcatgcacgcatgcctccgacgtgtctatgcgagttatttag

SEQ ID NO: 184 - DNA, 1146 bp, Zea mays
actctcctgaaaccagcgtgctgtgccgcccgggacgatggcgccgcgccagccactgctccccagtttcctctacgcggcgtcgtccggcgtcaacggcagcagggaggcgcctccggtggtggcgggcgccccgagcgagccgctcggcaagatcgagatgttctcgcccgcatactacgcagcgggcgccttgggaggcgccgcggcctgcgggttcacgcacgccgccgtcacgccgctcgacgtcatcaagtgcaatatccagatcgaccccgccaagtacaagaacacctcgtcggcgttcagcgtggtgatgagggagcagggcctccggggcttcttcagggggtgggcgccgacgttcgtgggctacagcgcgcagggcgcgttcaagtacggcctctacgagttcttcaagaagacgtacgccgacatggccggccccgagcacgccgccaggtacaagaccctcatctacctggcgggctcggccaccgcggaggttttcgccgacgtcgcgctctgccccatggaggccgtcaaggtccgggtgcagacgcagcccggcttcgccagggggctcagcgacggcttccccaagatcgtcagggccgagggctacgcagggctattcagaggactggttcctctttgggggcgacagattccttacaccatgatgaagttcgcgacgtacgagaacatcgtggagatgacctacaagcacctcatccccacgccgaaggaccagtgcagcaagcctctccagctcggggtaagcttcgggagcggctacgtcgccggagttttctgcgccgccgtctcgcaccctgcagacaacttggtgtcgttcctgaacaacgccaagggagccaccgttggagatgctgtcaagaaccttggcctgttgggcctcttcactcgtggcctccctcttcgcatcctaatggtcggcaccctgactggcgctcaatgggtgatctatgattccttcaaagttatgattggactgccaacgactggcggagcgcctgctcctgctactgtcccaatggaaggactcggagagctaaaagcctctgcctgaagttctaaagtttgacagagagtatgcatgcttccgtccatagcgtatactggtga

SEQ ID NO: 185 - DNA, 1446 bp, Secale cereale
cgctcactgtagtgtctactgcttgtgagggtgagcaatagtagtaccagctaggcagctacgctagctagctacatcgtgcggcggccatggcgagcagcagcagcagcctggccggtctggcggtgctgctcaccgccgtgctgtgcctgcagctgccggtccacagccgcgcgcagctgcgcgtggggttctacaacaccacctgccccaacgccgaggccatcgtccggcaggccgtcacggccgccttcgccaccaaccccggcgtcgccgccggcctcatccgcctccacttccacgactgcttcgtcgagggctgtgattcatcggtgctcctgtccgtcaaccccggcggaggcaagacggagcgtgaagcggcgcctaacaacccgagcctgcgtggctttgcggtcgtcgacgccgccagggccgcactggagcagagctgcccgcgcaccgtgtcatgcgccgacatcctggccttcgccgcccgggacagcgtgaacatcacgggcagcaacgccttctaccaggtcccttccggccgccgcgacgggaacctctcgaccgagggcggcgcgttcaccctcccggggccgaacctgacggcggacggccttgtcagcggattcgagatcaggggcctcaccgccgaggacatggtggtcctctccggctcccacaccctaggccgctcccactgcaactccttcatcgtgaggaaccgcgagcggctggcgagcggcacgatcagcccggcgtaccaggcgctgctggaggcgctgtgcccggcgaacacgagccagttcaccaacgtgacgacggagatcgacctgagcacgccggtggtgttggacaacaactactacaagctggtgcagctcaacctgggcctgcacttctccgacgaccagctcatccgcaacgccaccctcaaggccttcgtcgacaccttcgccgccaacgagacgctttggaaggagaagttcatcgccgccatgatcaagatgggcaacatcgcccccaagaccggcacgcagggggagatccgcctcaactgcagcatcgtcaacccgtcctcctcttcttcgtccgcttatgctggggtgatcgagatgctccgtcgcccgggctccgacgataaggtcgccatgggctaatgtacagtatgtacgcagagtaacgtgtgtggtgtttgggctgttgacacactggcacgtccttgcatgcgtatgcgtatgcaagggcgtgctggccggtcggggtgtctgttcgcacctaacttgtgatgaataataaaggctgtcgtgctctgagttgctgagtcatgcatgggctagatctggttggagcatgaatggtccaacacatcaccggcactatgttcgcgcgtcgcgagggctccatttattttcatctagtatagcagataccaaaaaaaaa

SEQ ID NO: 186 - DNA, 1547 bp, Triticum aestivum
gctcactgtgccgggcttgcgagggtgagcgataccagctagccacagcgcacgtacgacggccatggcgagcagcggcgggctggccggtctggcggtgctgctcaccgccgtgctgtgcctgcagctgccggtccacagccgcgcgcagctgcgcgtggggttctacaacaccacctgccccaacgccgaggccatcgtccggcaggccgtcacggccgccttcgccaccaaccccggcgtcgccgccggcctcatccgcctccacttccacgactgcttcgtcgagggctgtgattcatcggtgctcctgtccgtcaaccccggcggaggcacgacggagcgcgaggcagcgccgaacaacccgagcctgcgcggcttcgcggtcgtggacgccgccagggcggcattggagcagagctgcccgcgcacggtgtcatgcgccgacatcctggccttcgccgcccgggacagcgtgaacatcaccggcagcaacgccttctaccaggtcccttccggccgccgcgacgggaacctctcgaccgacaccggcgcgttcaccctcccggggccgaacctgacggcggacggcctcgtcagggggttcgcggaccggaacctgaccgccgaggacatggtggtcctgtcgggctcccacaccctgggccgctcccactgcaactccttcatcgtccggaaccgggagcggctggcgagcggcaccatcagcccggcgtaccaggcgctgctggaggcgctgtgcccggcgaacacgagccagttcaccaacgtgacgacggagatcgacctgagcacgccggtggtgctggacaacaactactacaagctggtgcagctcaacctgggcctgcacttctccgacgaccagctcatccgcaacgccaccctcaaggccttcgtcgacgccttcgccgccaacgagacgctgtggaaggacaagttcctcgccgccatgatcaagatgggcaacatcagccccaagaccggcacgcagggggagatccgcctcaactgcagcctcgtcaacccggcctcctcttcttcgtccgcctacgctggggtgatcgagatgctccgccgacagggctccgacgataaggtcgccaagggctgatgtatgcgtccttgaatgcgaatgcacgggcgtgctggccggtcggtgtccgttcgcacgtatactagacttgtgatgaatgatgaataataaacgctgtcgtgctctgagttgctgagtcatgcatgggctagatctggttggagcatgaatggtccaacacttcaccggcaccatgcgcgcgcgtcgcagtgctccattactacgaagcaccgatacggcgacatcgatacgacgatacagatacagggatacgggatatggtaattttgaaaaacagcaatacggcgatacggcagggatatataaataattaataaaatttcatattatgaagacaatgaattgaatgcctgagatgagatccaaatactgcccatttgttgcatccatgcttatttctcgatgacca

SEQ ID NO: 187 - DNA, 1437 bp, Secale cereale
cccctcactgtaccgggcttgcgagggtgagcgataccagctaagctaaagctagccacagcgtgcgtacgacggccatggcgggcagcagcggcctgaccggtctggcggtgctgctcaccgccgtgctgtgcctgcagctgccggtccacagccgcgcgcagctgcgcgtggggttctacaacaccacctgccccaacgccgaggccatcgtccggcaggccgtcacggccgccttcgccaccaaccccggcgtcgccgccggcctcatccgcctccacttccacgactgcttcgtcgagggctgtgattcatcggtgctcctgtccgtcaaccccggcggaggcaagacggagcgtgaagcggcgccgaacaacccgagcctgcgtggctttggggtcgtcgacgccgccagggccgcactggagcagagctgcccgcgcaccgtgtcatgcgccgacatcctggccttcgccgcccgggacagcgtgaacatcaccggcagcaacgccttctaccaggtcccttctggtcgccgcgacgggaacctctcgaccgagggcggcgcgttcaccctcccggggccgaacctgacggcggacggccttgtcagcggattcgagaccaggggcctcaccgccgaggacatggtggtcctctccggctcccacaccctgggccgctcccactgcaactccttcatcgtgaggaaccgcgagcggctggcgagcggcacgatcagcccggcgtaccaggcgctgctggaggcgctgtgcccggcgaacacgagccagttcaccaacgtgacgacggagatcgacctgagcacgccggtggtgctggacaacaactactacaagctggtgcagctcaacctgggcctgcacttctccgacgaccagctcatccgcaacgccaccctcaaggccttcgtcgacaccttcgccgccaacgagacgctgtggaaggagaagttcatcgccgccatgatcaagatgggcaacatcgcccccaagaccggcacgcagggggagatccgcctcaactgcagcatcgtcaacccgtcctcctcttcttcgtccgcttatgctggggtgatcgagatgctccgtcgcccgggctccgatggtaaggtcgccatgggctgatgtacagtatgtacgcagagtaacgtgtgtggtgttggcacactggcacgtccttccacgcttatgtgtatgcaagggcgtgctggccggtcggggtgtctgttcgcacctagacttgtgatgaataataaaggctgtcgtgctctgagttgctgagtcatgcatgggctagatctggttggagcatgaggccctccccaatgctccaccttgtacaggtgctaaggttgtcatgtaggtaaaaaatctgatgtggcaaggtaataaagaggagagaggtgagtatggt

SEQ ID NO: 188 - DNA, 1398 bp, Triticum aestivum
acccattatcgttgtgcagtcgacgctcactgtgccgtccttgtgagggtgagcagcagcagtaccagctacgctagctagctaggagtacatcgtgcggcggccatggcgagcagcagcagcagcctggccggtctgctgctcaccgccgtgctgtgcctgcagctgccggtccacagccgcgcgcagctgcgcgtggggttctacaacaccacctgccccaacgccgaggccatcgtccggcaggccgtcacggccgccttcgccaccaactccggcgtcgccgccggcctcatccgcctccactttcacgactgcttcgtcgagggctgtgattcctcggtgctcctgtccgtcaaccccggcggaggcacgccggagcgtgacgccgcgccgaacaacccgagcctgcgtggctttgcgctcgtcgacgccgccagggccgcactggagcagagctgcccgcgcacggtgtcgtgcgccgacatcctggccttcgccgcccgggacagcgtgaacatcaccggcagcaacgccttctaccaggtcccttccggccgccgcgacgggaacctctcgaccgaggccggcgcgttcaccctcccggggccgaacctgacggcggacggcctcgtcagcgggttccgggacaggggcctcaccgcggaggacatggtggtcctgtccggctcccacaccctgggccgctcccactgcaactccttcatcgtgaggaaccgggagcggctggcgagcggcacgatcagcccggcgtaccaggcgctgctggaggcgctgtgcccggcgaacacgagccagttcaccaacgtgacgacggagatcgacctgagcacgccggtggtgctggacaacaactactacaagctggtgcagctcaacctgggcctgcacttctccgacgaccagctcatccgcaacgccaccctcaagggcttcgtggacgccttcgccgccaacgagacgctgtggaaggagaagttcatcgccgccatgatcaagatgggcaacatcgcccccaagaccggcacgcagggggagatccgcctcaactgcagcatcgtcaacccgtcctcctcttcttcgtccggttacgcaggggtgatcgagatgctccgccgcccgggctccgacgataagctcgccatgggctgatgcgtagtgtgtacacagtgtgttgtgttggcacgtccttgaatgcgtgctggccggtcggtgtccggtcacgctagacattgttgatgaataataaaagctgtcgagctctgagttgccgagtcatgcatgagctagatctggttggagcaggaatggtccaacacatcaccggcaccatgcgcgcgcgtcgcagtgctccattattgccaactcgcttgtttt

SEQ ID NO: 189 - DNA, 1192 bp, Hordeum vulgare
gcatgcatgcaaacaaatcactagcgagccgcatacgtacatcacaacgaagcgcggcacgcaatggcgccctcctcgtcgtctccactgccggcgtctccgctgctcgtgctgctgatggtgccgctcctgctcgccatggcgcgtccgtgctccggcgtggacgccatcggcacctactgcgctaagaacggcaccagcgcggagacgcaggccagcatcgaccaggtcctcgcggcgctcgtcccgcgcgcctcggcggcgtactacgccacggccaccgccggccgctcctcgtccgcggtctggggcctcgcgcagtgccgcggcgacgtcccgcgtcaggactgctcgctctgcctcgccgcggcggccaaggaggtcgcgtcgtcctgccgaggcagctcggacgggcgcgtcttctacgactactgcctcctccgctactccaccgccaacttcatcggcctcgctgacacggggtacacgctcatcctcctcaacacccagaacgccaccggcgtcgacctggccgcgttcgaccgggcgcaggggaagctcatgtcccgcgtcgcctccgaggccggcgacgccgccaacaagggcctggcgacggacacgacgcgactcggcagcgatggtggcggagccaagacgaccatctacgggctcgggtggtgcaccagggacatcacggcggccgactgcgggctgtgcgtggcgcaggctgtggccgagctgcccaactactgccggtaccggcgcgggtgccgcgtgatctacagcagctgcatggcgcgctacgaggtgtaccccttcttcttcccgctcgacggcaccgacaagtcggccgacgaggtcggacagtgcgacaagattgtcttgaacgcgtgatgtatttgtttgtggagtacaaactacgtgtagtcaactacggtgctatctacgagggcactccagctcgttgtgcgtacctggtcctggtggtggtggcgaatccatttgttagtgtatggctagctcgtagctagccttgaatccaagccttgtgtttgtttgtgtacatgtttgctcgtgaaaatataatttcgcgcaaaccaccattgtgtaattttcatatttgcaaaaccactatctacctagagtaattacttatttgaaagtagttgaatgcaactttgacttgtcggcc

SEQ ID NO: 190 - DNA, 1370 bp, Aegilops tauschii
cacatgcacacagtctccaaccattaaaacacaagagacatggatgcatcttctcgtccattatggctgcgcatagagccatcagccatggaccaagcacccatcactcactgcccgctctataagaaacgaacctatgcatgcaaacaaatcactagtagcagctatagccacacacatcacatcaaagcgtaggcacgcaatggcgtcctcctcctcgtctccgctgctcatgttgctgctgctgccgctcctgctcgccatggcgcgcccgtgctccgccgtcgacgctatcggcacctactgcgccaagaacggcaccagcgcggagacgcaggccagcatcgaccgagtcctcgcggcgctcgtcccgcgcgcctcggccgcctactacgccccggccaccgccggccgctcctcgtccgcggtctggggcctcgcgcagtgccgcggcgacgtgccgcgccaggactgctcgctctgcctcgccgccgcggcccaggaggtcgcgtcgtcctgccgcggcagctccgacggccgggtcttctacgactactgcctgctccggtactccacctccaacttcgtcggcctcgcggacacgggctacacgctcatcctcctcaacacccagaacgccaccggcgtcgacctggccgcgttcgaccgggcgcaggggaaactcatgtcccgcgtcgcctccgaggccggcgacgccgccaacaaggggcttgcgacggacacgacgaggctcggcagcgagggcggcggagccaagacgaccatctacgggctcggctggtgcaccagggacatcacggcggcggactgcgggctttgcgtggcgcaggcggtggcggagctgcccaactactgccggtaccggcgtgggtgccgcgtcatctacagcagctgcatggcgcgctacgaggtgtaccccttcttcttccccctcgacggcgccgacgagtcggccgacgagctcggacagtgcgacaagatcgtcttgaactacccgtgatgggtggagtacagctacgtagtcaactacggtgctagtatctactgtacgtagcactctagctcgttgtgcgtacctggtggtggcgaatccatttgtagtgtatggctagctcgtagctagcctagaatccaagcagggtcaaaataattttcgttaagtgcaaaataataagcgaaaaactagccttgtgttcctcgcacatgtttgcttgtgaaaatacatttcgtgcaacaacctatccttgtgtaatttccatatttgcaaaactactacccacgaaagttaattaatttcatactgcctgtggtgacttcgtcaatcataaatcataagatgctatgccggt

SEQ ID NO: 191 - DNA, 1110 bp, Triticum aestivum
cacacacatcacatcaaagcgcagcgagcaacgcaatggcgtcctcctcctcgtctccgctgctcatgctgctgctgctcccgctcctgctcgccatggcgcgtccgtgctccgccgtcgacgccatcggcacctactgcgccaagaacggcaccagcgcggagacgcaggccagcatcgaccaggtcctcgcggcgctcgtcccgcgcgcctccgccgcctactacgccacggccaccgccggccgctcctcgtccgcggtctggggcctcgcgcagtgccgcggcgacgtcccgcgccaggactgctcgctctgcctcgccgcggcggccaaggaggtcgcgtcgtcctgccgcggcagctcggacggccgggtcttctacgactactgcctcctccggtactccacctccaacttcatcggcctcgcggacacggggtacacgctcatcctcctcaacacccagaacgccaccggcgtcgacctggccgcgttcgaccgggcgcaggggaagctcatgtcccgcgtcgcctccgaggccggcgacgccgccaacaaggggctggcgacggacacgacgcggctcggaagtgacggcggcggagccaagacgaccatctacgggctcgggtggtgcaccagggacatcacggcggcggactgcgggctgtgcgtggcgcaggcggtggcggagctgcccaactactgccggtaccgccgcgggtgccgcgtgatctacagcagctgcatggcgcgctacgaggtgtaccccttcttcttcccgctcgacggcgccggcgagtcggccgacgaggtcggacagtgcgacaagatcgtcttgaactacccgtgatgggtggagtacagctagtcaagtagagtgctatctacaagcactctagctcgttgtgcgtatctggtggtggcgaatccatttgttagtgtatggctagctcgtagctagcctagaatccaagcggggtccaaataattctcgttaagtgcaaaataataagcgaaataatagcctcgtggttgtttgtgtacatgtttacttgtgaaaataaatttcgtgcaaactaccgtcatgtaatttccatatttgcaaa

SEQ ID NO: 192 - DNA, 1158 bp, Aegilops tauschii
attgcatctagtctagtagtaacatggagccatcagccaagcacagatcactcgctgcccgctctataagaatctcacgcgcacccacgagcccatgcatgcaaacaaactagtagctagtgagccacacacaacacatcacatctaagcgcatgcagcaggcgatggcgtcctcctcctcgtctccactgctcatgctgctgctggtgccgctcctgctcgccatggcgcgtccgtgctccggcgtggacgcgatcagcacgtactgcgccaagaacggcaccagcgcgcagacgcaggccagcatcgaccaggtcctcacggcgctcgtcccgcgcgcctcggccgcctactacgccacggccaccgccggccgctcctcgtccgcggtatggggcctcgcgcagtgccgcggcgacgtcccgcgccaggactgctcgctctgcctcgccgcggcggccaaggaggtcgcgtcgtcctgccgcggcagctcggacggtcgggtcttctacgactactgcctgctccggtactccagctccaacttcatcggcctcgcggacactgggtacacgctcatcctcctcaacacccagaacgccaccggcgtggacctggccgcgttcgaccgggcgcaggggaagctcatgtcccgcgtcgcctccgaggcccgcgacaccgccaacaagggtcttgcgacggacacgacgcggctaggaggcggcggcggcggagccaagacgaccatctacgggctcgggtggtgcactagggacatcacggcagcggacagcgggctgtgcgtggcgcaggcggtggcggagctgcccaactactgccggtaccggcgcgggtgccgcgtgatctacagcagctgcatggcgcgctacgaggtgtaccccttcttcttcccgctcggcggcgcccgcgagtcggccgacgaggtcggacagtgcgacaagatcgtcttgaacgcatgatgggtggagtacatctagtcaactacagtgctatctacatagcacgctagctcgttgtgcgtacctggtggtggcgaatccatttgttagtgtctgggtagctcgtagctgacctagaatccaagcggggtccaaataatttcaataattgcaaaataagctaaatacaagccttttt

SEQ ID NO: 193 - DNA, 1047 bp, Leymus cinereus x Leymus triticoides
catcatccccgcaagcacgcaatggcgtcctcctcgtcgtctccgcagctcatgctgctgctgctgccgctcctgctcgccatggcgcgtccctgctccggcgtggacgcgatcggcacgtactgcgccaagaacggcaccagcgcggagacgcaggccagcatcgacgaggtcctcgcggcgctcgtcccgcgcgcctcggccgcctactacgccacggccaccgccggccgctcgtcgtcggcgatatggggccttgcgcagtgccgcggcgacgtcccgcgtcaggactgctcgctctgcctcgccgcggcggcgaaggaggttgcgtcgtcctgccgcggcagcgcggacgggcgggtcttctacgattactgcctgctccggtactccagctccaacttcgtcggcctcgcggatacggggtacacgctcatcctcctcaacacccagaacgccaccggcgtcgacctggccgcgttcgaccgggcgcaggggaagctcatgtcccgcgtcgcttccgaggccggcgacgccgccaataaggggctggcgacggacacgacgcggctaggaggcggcggtggcagagccaagacgaccatctacgggctcgggtggtgcaccagggacatcacggcggcggactgcgggctgtgcgtggcgcaggcggtggcggagctgcccaactactgccggtaccggcgcgggtgccgcgtgatctacagcagctgcatggcgcgctacgaggtgtaccccttcttcttcccgcttggtggcgccggcgagtcggccgacgaggtcggagagtgcgacaagatcgtcttgaacgcgtgatgggtggcgtacagctagtcaaccacagtgctatctagcactctagctcgttgtgcgtacctggtggtggcgaatctatttgttagtgtatggctagctcgtagctggtctagaatccaagcggggtccaaataattttcggtaaatgcaaaataagagaaatatgtggttgtttgtacatgtttgcttgtgaaaataaaatttcatgca

SEQ ID NO: 194 - DNA, 1805 bp, Secale cereale
acactgcctggacgcctatttatccatccttggaacatctgcaacaccaaagaaaccaagaacaagactgaaaacatggagaccacggtcaccgcggcgacagccaccaccagctcgagcgtcggccacggagccggcggcggtgctgcgagagtcctgctcctcccggtcccgggggcgcagggccacaccaacccgatgctccagctcggccgccgcctggcgtaccacggcctccgccccacactcgtcgccacccgctacgtgctctccaccaccccgccccccggcgagcccttcggcgtggccgcgatctccgacggcttcgacgccggcggcatggcctcgtgcccggacatggcggagtacttctcgcggctggcggccgtgggctccgagacgctgcgggagctcctcctgtcggaggcgcgcgcggggcggcccgtgcgcgtgctggtgtacgacgctcacctggcgtgggcgcggcgggtggcgcaggcgtccggcgtcgcggccgcggccttcttctcccagccgtgcgcggtggacatcgtctacggggagctgtgggcggggcggctggcgctgccggcgacggacgggcgcgcgctgctcgcgagaggagcgctcggcgtggagctggggctggaggacatgccgccgttcgcggcggtgccggagtcgcagccaacgttcctcaaggtgtcagttgggcagttcgaggggctggaggacgccgacgacgtgctcgtcaactcattccgcgacctcgagccaaaggaggtagagtacttggaattaacatggagagcgaagatggttggcccaaccttgccatcattctacctcgacgatgatcgcctaccatccaataaatcatatggtttcgatttgttcaacagtgatgcattgtgcatggattggctagagaagcaaagcaattcatccgttgtgctggtgtcctatgggactgtctctaattatgatgcaacccagctagaggagcttggcaatggactgtgcaattccggcaaaccttttctttgggttgtaaggtccaacgaggaacacaagttatccaaagaactcaaggaaaaatgtgagaagattggattaattgtctcatggtgcccccagcttgaggttcttgcacatagggctattggttgcttcgttacccactgtggatggaactcgacactagaggcacttgttaatggtgtacctcttgtgggtattccgcattgggctgatcaacccaccattgcaaagtatatggagagtgcatggagcatgggtgtgcgtgtacaaaaggacgataatggatgtctaaagatggaggaggttgagaggtgcattagagaggtgatggatgcggagagaaatgatgagtacaaaaaaaatattgtgaagtggatgcaaaaggccaaggaggcaatgcaggaaggaggaagttcagacaagaacatcgctgagttcgctaccaagtattcgtcaatatgaagtttgaacaatgttttacttcaatataagcaagaaggcagtggtttcagccttataaaagtttagagcggccggcattttccatatgtaattgtagtgatatctcctttacatttagaagcatgctgaactttttatacatgtacgccgtgcaatctttttacatgttatatattctagtacggaaagtgcactacatcatctgtagatagccctctcccctaagtattaccgacatttatcaaagtaggaggtgggggttcccaaagagatggcttacaaaaaattcccatcgtaatttt

SEQ ID NO: 195 - DNA, 1582 bp, Triticum aestivum
acagagctgaaacatggagaccacggtccccgcggcgacagccaccaccagctcgagcgtcggccacggagccggcggcggtgctgcgagagtcctgctcctcccgtacccgggggcgcagggccacaccaacccgatgctccagctcggccgccgcctggcgtaccacggcctccgccccacactcgtcgccacccgctacgtgctctccaccaccccgccccccggcgcgcccttcggcgtggccgccatctccgacggctgcgacgccggcggcatggcctcgtgcccggacatggcggagtacgtctcgcggctggcggccgtgggctccgagacgctgcgggagctcctcctgtcggaggcgcgcgcggggcggcccgtgcgcgtgctggtgtacgacgctcacctggcgtgggcgcggcgggtggcgcaggcgtccggcgtcgcggccgcggccttcttctcccagccgtgcgcggtggacgtcgtctacggggagctgtgggcggggcggctggcgctgccggcgacggacgggcgcgcgctgctcgcgagaggagcgctcggcgtggagctggggccggaggacatgccgccgttcgcggcggtgccggagtcgcagccaacgttcctcaaggtgtcagttgggcagttcgaggggctggaggacgccgacgatgtgctcgtcaactcattccgcgacctcgagccgaaggaggtagagtacatggaattaacatggagagcgaagatggttggcccaaccttgccatcattctacctcaacgatgatcgcctaccatccaataaatcatatggttttaactttttcaacggtgatgcactgtgcatggattggctagagaagcaaagcaattcatccgttgtgctggtgtcctatgggactgtctctaattatgatgcaacccagctagaggagcttggcaatggactgtgcaattccggtaaaccttttctctgggttgtaaggtccaacgaggaacacaagttatccaaagaactcaaggaaaaatgtgagaagattggattaattgtctcatggtgcccccaacttgaggttcttgcacatagggctattgcttgctttgttacccactgtggatggaactcgacactagaggcacttgttaatggtgtacctcttgtgggtattccgcattgggctgaccaacccaccattgcaaagtatatggagagtgcatggagcatgggtgtgcgtgtacggaaggacaataatggatatctaaagatggaggaggttgagaggtgcattagagaggtgatggatgtggagagaaaggatgagtacaaaagaaatgttgtgaagtggatgcaaaaggccaaggaggcaatgcgggaaggaggaagttcagacaagaatatcgctgaattcgctaccaagtattcatcaatataaagtttgaacaatgttttacttcaatataagcaagtaggcagtgattttggccttacaaaagtttagagtggccgacattttccatatgtaattgtagtgatatcttcttcatgaaggaaatatgccctagatgcaataata

SEQ ID NO: 196 - DNA, 1551 bp, Secale cereale
cggcagcgggcagcacgccagctcgagcgtcggccacgggcggcgcggtgctgcgacgagtcctgctcctcccggtcccgggggcgcagggccacaccaacccgatgctccagctcggccgccgcctggcgtaccacggcctccgccccacactcgtcgccacccgctacgtgctctccaccaccccggcccccggcgagcccttcggcgtggccgcgatctccgacggcttcgacgccggcggcatggcctcgtgcccggacatggcggagtacttctcgcggctggcggccgtgggctccgagacgctgcgggagctcctcctgtcggaggcgcgcgcggggcggcccgtgcgcgtgctggtgtacgacgctcacctggcgtgggcgcggcgggtggcgcaggcgtccggcgtcgcggccgcggccttcttctcccagccgtgcgcggtggacgtcgtctacggggagctgtgggcggggcggctggcgctgccggcgacggacggccgcgcgctgctcgcgagaggagcgctcggcgtggagctggggccggaggacatgccgccgttcgcggcggtgccggagtcgcagcctgtgttcctcaaggtgttagttgggcagttcgaggggctggaggacgccgacgatgtgctcgtcaactcattccgcgacctcgagccgaaggaggtagagtacatggaattaacatggagagcgaagatggttggcccaaccttgccatcattctacctcgacgatgatcgcctaccatccaataaatcatatggttttgatttgttcaacagtgatgcattgtgcatggattggctagagaagcaaagcaattcatccgttgtgctggtgtcctatgggactgtctctaattatgatgcaacccagctagaggagcttggcaatggactgtgcaattccggcaaaccttttctttgggttgtaaggtccaacgaggaacacaagttatccaaagaactcaaggaaaaatgtgagaagattggattaattgtctcatggtgcccccagcttgaggttcttgcacatagggctattggttgcttcgttacccactgtggatggaactcgacactagaggcacttgttaacggtgtacctcttgtgggtattccgcattgggctgatcaacccaccattgcaaagtatgtggagagtgcatggagtatgggggtgcgtgtacggaaggacgataatggatgtctaaagatggaggaggtcgagaggtgcattagagaggtgatggatgcggagagaaaggatgagtacaaaagaaatgctgtgaagtggatgctaaagtccaagaaggcaatgcaggaaggaggaagttcagacaagaatatcgctgagttcgctatcaagtattcgtcaatatgaagtttgaacaatgtttttcttcaatataagcaagtaggcagtggtttcagccttctaaaagtttagagcggtcggcattttacatatgtaattgttcttggaaatttgccctagaggcaataataaaatggttattattata

SEQ ID NO: 197 - DNA, 1860 bp, Aegilops tauschii
cacacgtcgcgtgtccttgccccgtacgtacctcccatcccatccacccaaaaataaccgagagagagaccgagcgcgccttcgctgccccgcgggtcaaatccaggcccgaatacgagctcaaaaaccacgtgcctccgtgaccacccacggcccctgatattcatcgcctacactccacgaccttttccctcgatgggaccgtcgcggacggagacctcaccgctccacccgcccggtcgtgcccacgactcggaagaacccagtgagctgcccctccattcccccacgttttccatgcccggcccgacgggtccttgtcgtcccacctcgccgtttatcacgaagagccgatccattttaaaagggcggaggcgcccggcaggaggaaaagtgcactggagttgtttgtcggaggcagcaggcaagccaaggaaggagcgaggaagctagccgcggtggagaggcgacttgtttcttgtgcatggaaggggcggggagcggcgggaagatgggcggaggagaggggatggccggccgtgccggtgccggtgccgcgtcggcggcgaaggagaagtccggcttcgccgccacctgcagcctcctgagccgctacatgaaggagaagaagggcggcgcactgcagggcctcgtcggcctcgacatgtcgccgccggccgccgtcgtcgtaggagaaggagctttccagccgcccaccaccatgaacctgttgtcggggctggaggagccaaacgccgcggacgtggagctccgcctcgagaaatctagtgttggccagtttctcaaggccacaactgacaaccaagatgccggagaggatgcgcaccagctcaccatcttctatggtggaaaggtggtcgtggttgacaacttcccgtccaccaaggtcaaggatttgctgcagatggccgacggcgccggagacaagaccgggagcagcagcctcgctcagcagagccctccccagcctgcacagaacgctctccctgatctgcctatagcgaggaggaactcactgcataggtttctcgagaaaagaaagggcaggatagtggcgaaggcgccttaccaaattaacagctcatcggcggctccgtccaagcaagctaatggtgacaactcctggctcgggctaggccaagaagtgacaaactgacagtacaagaaagatacgcatgatgaacacgtgactgggctccaaatctatagggcaattgatctacggggagcgtggatgttactactagtactgccagtttactcgtagctttgaagcgacaataatcgggtgttggttattcattgctagtaagaattattagtagaaatatgtatttaagcatatgccgtctgttcggaccattgtttgctgctggagctgtgtatgctctgctcacggcagtttggcaggctaggtctactacgactattgtcatggtcattttattgcaagttaatttgcaacatgttacagatggtttgccttcctcaacatgtgatttcctgctaacatgggctgctcagttttcagggatttgtatgttacttgagattttataaaatatatattgtttgagatgatccttttagtttagttgaacttgtgctttcaatatagccgtgtttttgctaattagaaactttgttcatggatcatggatgatcagaccatcaaagcggatctaatgttcagcaaaaccacaccgcattatggaatacaaaaagtgtagagcttaaggcaactccaatgcggggcgccagctatccaacctaggcatgaaatgtccgtccggtcattttttttttctgtgctcaaagtactgaaaataatcaaagata

SEQ ID NO: 198 - DNA, 1449 bp, Triticum aestivum
catcgcctacactccacgaccttttccctcgatgggaccgtcgcggacggagacctcaccgctccacccgcccggtcgtgcccacgactcgaagaacccagtgagctgcccctccattcccccacgttttccatgcccggcccgacgggtccttgtcgtcccacctcgccgtttatcacgaagagccgatccattttaaaagggcggaggcgcccggcaggaggaaaagtgcactggagttgtttgtcggaggcagcaggcgagccaaggaaggagcgaggaagctagccgcggtggagaggcgacttgtttcttgtgcatggaaggggcggggagcggcgggaagatgagcggaggagaggggatggccggccgtgccggtgccggtgccgcgtcggcggcgaaggagaagtccggcttcgccgccacctgcagcctcctgagccgctacatgaaggagaagaagggcggcgcactgcagggcctcgtcggcctcgacatgtcgccgccggccgccgtcgtcgtaggagaaggagctttccagcctcccaccaccatgaacctgttgtcggggctggaggagccaaacgccgcggacgtggagctccccctcgagaaatctagtgttggccagtttctcaaggccacaactgacaaccaagatgccggagaggatgcgcaccagctgaccatcttctatggtggaaaggtggtcgtggttgacaacttcccgtccaccaaagtcaaggatttgctgcagatggccgacggcgccggagacaagaccgggagcagcagcctcgctcagcagagccctccccagcctgcacagaacgctctccctgatctgcctatagcgaggaggaactcactgcataggtttctcgagaaaagaaagggcaggatagtggcgaaggcgccttaccaaattaacagctcatcggcggctccgtccaagcaagctaatggtgacaactcctggctcgggctaggccaagaagtgacaaactgacagtacaagaaagatatgcatgatgaacacgtgactgggctccaaatctatagggcaattgatctacggggagcgtggatgttactactagtactgctagtttactcgtagctttgaagcgacaataatcgggtgttggttattcattgctagtaagaattattagtagaaatatgtatttaagcatatgccgtctgttcggaccattgtttgctgctggagctgtgtatgctatgctcacggcagtttggcaggctaggtctactacgactattgtcatggtcattttattgcaagttaatttgcaacatgttacagatggtttgccttcctcaacatgtgatttcctgcaaacatgggctgatgagttttcagggatttgtatgttacttgagattttataaaatatatattgtttgagatgatccttttagttt

SEQ ID NO: 199 - DNA, 1140 bp, Secale cereale
ggagcgaggtagctgcggtggagaggcgacttgtttgttgtgcatggaaggggcggggagcggcgggaagatgggaggaggagagggcatggccggccgtgccggtgccggtgccgcggcggcgaaggagaagtccggcttcgccgccacctgcagcctcttgagccgctacatgaaggagaagaagggcggcgcgctgcagggcctcctcggcctcgacatggcgccgccggctgccgtcggcgacgaaggaggatctttccagccgcccaccaccatgaacctgctgtcggggctggaggagccaaacaccacggacgtggagctcccactcgagaaatctagtgctggccagtttctcaaggccacaactgacaaccaagatgccagagaggatgcgcaccagctcaccatcttctatggtggaaaagtggtcgtggttgacaacttcccgtccaccaaggtcagggatttgctgcagatggccgacggcgccggagacaaggccgggagcagcagcctcgttcagcagagccctccccagcccgcacacaacactctcccagatctgcccatagcgaggaggaactcactccataggtttctcgagaaaagaaagggcaggatagtggcgaaggcgccttaccaaattaacagcgcatcgacggctccgtccaagcaagctaatggtgacaactcctggctcgggctaggccaagaagtgacaaactgacggcacaagaaagagatgtgatgaacacttgacgtggctccaaatctatagggcagttgatctacggggagcgtagtttactctagctttgaatcgacaataatcgggtgttggttattcatttctagtaacaattagtagtactggccggtggttaattccaattgattatcggcgtagataaatatttaagcacatgccgtctgttcgtaccattgtttgctgctggagctgtgtatgctcacggcagtttggcaggctataggtctcctaggagtactgtcatggtcattttattgcaagttcgcaacatattacagatggtttgccttcctcaacatgtcactgaaagttgtaactatccttgattcatgcagcgctcgtttccctgcttacattggctgctc

SEQ ID NO: 200 - DNA, 1079 bp, Triticum aestivum
cggaggcagcaggagagcgaaggaaggagcgaggaagcttgctgcggtggagaggcgacttggtttgctgtgcatggaaggggcggggagcggcgggaagatggcaggaggagagggcatggccggccgtgccggtgccggtgccgcggcggcggccaaggagaagtccggcttcgccgccacctgcagcctcctgagccgctacatgaaggagaagaagagcggcgcgctgcagggcctcgtcggcctcgacatgtcgccgccggccgccgtcgtcggtgaagaaggagctttccagccgcccaccaccatgaacctgctgtcggggctggaggagccaaacgccgcggacgtggagttccccctcgagaaatctagtgttggccagtttctcaaggccacaactgacaaccaagatgccggacaggatgcgcaccagctcaccatcttctacggtggaaaagtggtcgtggttgacaacttcccgtccaccaaggtcaaggatttgttcaagatggccaacggcgccggcgacaaggccgggagcagcagcctcgttcagcagagccctccccagcctgcacacaacactctcccagatctgcccatagcgaggaggaactcactccacaggtttctcgagaaaagaaagggcaggatagtggcgaaggcgccctaccaaattaacggctcatcggcggctccgtccaagcaagctaatggtgacaactcctggctcgggctgggccaagaagtgacaaactgacggtacaagaaagatatgcatgatgaacacttgaccaggctccacatctatagggcaattgatctacggggagcgtggatgttattttactactagtgcaggtagtttactcgtagctttgaagcgacaataatcgggtgttggttattcatttatagtaagaattattagtagatatatgtatttaagcatatgccgtctgttcggaccattgtttgctgctggagctgtgtatgctcacggcagtttggcagcctaggtctactaggactattgtcatggtcattttattgcaagtttgcaacgtattaca

SEQ ID NO: 201 - DNA, 1642 bp, Aegilops tauschii
ctgaaagtgacattggtggggcaccatttgttggaaaaaccaaccagttgcctgttgccatgcgacgacttgcatgcacataattttcaaagtcttccactgaccaacgaggcagtgagcacggaacacacacatcatcgcctaagtacaaatctacacatcttcttcaggctttaggccttcatccattcttcctccacctccttcaggcttcgaccagatcacagctctccagttactaccagccatggctgccaagaccacctcatgcttcaccttcctcaaggaagcgctggtcctccccacgcgaaaccccaagctcttcgcccccatcctcatctttgtggccgccatcgccttcctcatccccgcggtcaacgtggtcttcatccagccgctcaccgccgagatgctgcaccacgtcgccgagatgcagaccaccgacccctcgagcgccgagtacgccaggctcctggaggagatacgtcaggaggccagggagctcgtcctcatcgccgtcgccctcacggtcgtcaccctgccgctcgtcttcgccaagcagatcctcgccttctccgcggcctccacgacgtactccggcgaccgctactccctcgcggagctcctccgcagggtgaccaagtgggccaacctgaggggccctctcgtcaccgtgggcgtggtcaccgcgctccagctcacgttcatggcgctcctgggcgtctacctctccgccgtcatgcgccacgcgggggtgctctccgtgcaaggcgcggtcttcgtcctcgcctttctcgccttcatgtacttcggggtcgtggccgtggtgggcgtcgccgtgtcggtggccgacgaggggtgccgcggcgtgcgcgcgctcgggcgggcgtggcggctcatgacgcgggtgaggcggaaggagggcgccctgctggcggcggtgatggtcctcctgccgaccgttgtgagcccggtgtacgcgctcgcgctcacgtacgccaggaagagcatggcggtggggctgtacctgctgtttgggtacgctcttctgtctgctgcggtgcaggtgttctacatcgcggcggctacggtgtactactatgaggccatggagagcaaagaggtggtggtgacttttcatggctatgccaagataccttccggtgagggtgaggcaaatgtctgattgatcggccggccccgtataatgagtcatgtacttgtggtgcttcctagctgtgtgataatagtctttgtactacgtatacatacataagagtaaaaatataagtgtaggtcaacaaatttgtattcccttctttctatggtcaagtgcacatattcaggtcatgaactttggattagtcagtcaaggcagtgggcggagcctgaatcttgcaaggcatgggctaactggggatgggcaaagtaggaggagaatggtgaagatgcattgtttaaaacattttgagttctgcaacaatagttgcacccatcgcagaatatcactagcacacgaccggctactagttgatgattgccacaactaatcagggtcgggttttttggtggctttttgggcttctagaataagttgcctccaccctgctcattctagaagtccaacaaaaaatatatgttt

SEQ ID NO: 202 - DNA, 1347 bp, Triticum aestivum
ggcttcgaccagatcacagctctccagttactaccagccatggctgccaagaccacctcatgcttcaccttcctcaaggaagcgctggtcctccccacgcgaaaccccaagctcttcgcccccatcctcatctttgtggccgccatcgccttcctcatccccgcggtcaacgtggtcttcatccagccgctcaccgccgagatgctgcaccacgtcgccgagatgcagaccaccgacccctcgagcgccgagtacgccaggctcctggaggagatacgtcaggaggccagggagctcgtcctcatcgccgtcgccctcacggtcgtcaccctgccgctcgtcttcgccaagcagatcctcgccttctccgcggcctccacgacgtactccggcgaccgctactccctcgcggagctcctccgcagggtgaccaagtgggccaacctgaggggccctctcgtcaccgtgggcgtggtcaccgcgctccagctcacgttcatggcgctcctgggcgtctacctctccgccgtcatgcgccacgcgggggtgctctccgtgcaaggcgcggtcttcgtcctcgcctttctcgccttcatgtacttcggggtcgtggccgtggtgggcgtcgccgtgtcggtggccgacgaggggtgccgcggcgtgcgcgcgctcgggcgggcgtggcggctcatgacgcgggtgaggcggaaggagggcgccctgctggcggcggtgatggtcctcctgccgaccgttgtgagcccggtgtacgcgctcgcgctcacgtacgccaggaagagcatggcggtggggctgtacctgctgtttgggtacgctcttctgtctgctgcggtgcaggtgttctacatcgcggcggctacggtgtactactatgaggccatggagagcaaagaggtggtggtgacttttcatggctatgccaagataccttccggtgagggtgaggcaaatgtctgattgatcggccggccccgtataatgagtcatgtacttgtggtgcttcctagctgtgtgataatagtctttgtactacgtatacatacataagagtaaaaatataagtgtaggtcaacaaatttgtattcccttctttctatggtcaagtgcacatattcaggtcatgaactttggattagtcagtcaaggcagtgggcggagcctgaatcttgcaaggcatgggctaactggggatgggcaaagtaggaggagaatggtgaagatgcattgtttaaaacattttgagttctgcaacaatagttgcacccatcgcagaatatcactagcacacgaccggctactagttgatgattgccacaactaatcagg

SEQ ID NO: 203 - DNA, 1373 bp, Triticum aestivum
cacacacatcatcgcccaagtacaaatctacacatctgcttccggcttcaggccttgatccattcttcctacaattccttgaggcttcgaccagatcacaactctccagttaccgccagccatggctgccaagaccacctcatgcttcaccttcctcaaggaagcgctggtcctccccacgcgaaaccccaagctcttcgcccccatcctcatcctcctggccatcatcgccttccttgtccccgccgtcaacgtggtcctcatccagccgctcaccgcccagatgctccgccacctcaccgagatgcagaccaccgacccctcaagcgccgagtttgccaggctcctggaggagatacggcaggaagccagggagctcgtcctcatctccgtcggcttgtttttcgtcaccctggcgctggtcttcgccaagcagatcctcgccttctccgcggcctccacgacctactccggcgaccgctactcgctcgccgagctcctccgaagggtgaccaagtggggtaatctgaggggccctctcgtcaccgtgggcgtggtcaccgcgctccagctcacgttcatggcgctcctgggcgcctacctctccaccgtcatgcgccacgcggaggcgctctccgtgcaaggtgcgctcttcgccctcgctttcctggccttcatgtacttcggggtggtggctgtggtgggcgtcgccgtgtcggtggccgacgaggggtgccgcggcgtgcgcgcgctcctgcgggcgtggcggctcatgatgcgggtgagcaggaaggagggcgccctgctggcggcggtgatgctcctcctgtcgaccgttgtgagcccggtgtacgcgctggcgctcgtgtacgccaagaagagcatggcggtggggctgtgcctgctgttcgggtatgctctcctgtctgctgcggtggagctgttctacatggcggcggccacggtgtactactatgaggccatggagagcaaggaggcgatcctggcttttgatggctactatgccaagataccttccggtgagggtgaggcaaatgtctgattgatcggtcggccccgtataatataatgactaatgagtcatacatatacttgtggtgcttcctagctgcgtgatcattatcattgtactacgtacatttgactaagtcaatcctcgattatacatacagatacaggagagtaaaaatacaagtgcaggtcagcaaatttgcattcccttctttgtatggtcagctgcacatattcaggtcatgaaatttggattagtcagtcaatgcagtgtgcggagccagacccttgcaaggcatagggctaacaggcagtggcggagctagcatttgacatcaggg

SEQ ID NO: 204 - DNA, 1114 bp, Leymus cinereus x Leymus triticoides
cagatcccttactcaagttaccagccatggctgccaagaccacctcccccttcaccttcctcaaggaagcgctggttctccccacgcgaaaccccaagctcttcgcccccatcctcatcctcctggccgtcatcgccttcctcgtccccgcggtcaacgtcgtctccatccagccgctcaccgccgagatggtccgccacctcaccgagatgcagaccaccgacccctcgagcgccgagtacgctaggctcctggaggagatacggcaggaagccagggagctcgttctcatcgccgtcggcctctcgctcgtcaccctggcgctcgtcttcgccaagcagatcgtcgccttctccggggcctccacgacctactccggcgagcgctactccctcgccgagctcctccgctgggtgaccaagtggggaaacctgaagggccctctcgtcaccgtcgccgtggtcaccgcgctccagctcacgttcatggcgctcctgggcgtctacctctccaccgtcatgcgccacgcagaggtgctctccgtgcaaggcgtgctcttcgtcctcgccttcctggccttcatgtacttcggggtcgtggccgtggtgggcgtcgccgtgtcggtggccgacgagcggtgccgcggcgtgcgcgcgctccggcgggcgtggcggctcatgacgcaggtgagcaggaaggagggcgccttgctggcggcggtgatggtcctcctgccgaccgttttgagcccactgtacgggctcgcgctcgtgtacgcccagaagagcatggcagtggggctgtgcctgttgtttgggtatgctcttctgtctggtgtggtggagctgttctacatcgcggcggccacggtgtactactatgaagccatggagagcaaagaggcggtggtggcttttgacggctatgccaagataccttccggtgaggcaaatgtctgatcgatcggctggcccccgtataatgagtcatatacttgtggtgcttcctagctatgtgatcattatcattgtactactatatgttactagctgaatgcccgtgcgttgccacggatcaacaaaaacacataatgatcaaatagttgttctaatta

SEQ ID NO: 205 - DNA, 1817 bp, Triticum aestivum
gtccattccaatttcctaagcacgcccaccgagagggaaaggcaatgaatcttgaatcggtactgagtccagcagcactaccgtggagctacctcgcctgcggcctcttgagcttggcgctcctagtcctatggccaaccacccggctgctagagcagctatggtggcggccgaggcgcctggaacgggctcttcgcgcccagggccttcgtgggacgtcctacagtttcctcctcggcgacatgagcgactacggcaggcaaaacaaggaggcatggtccaagcccctgccgctgcgctgccacgacatcggcgcacacgtcatgcctttcctctacagaaccgtccaggagcacggcaagcagtgcatctcctggttcggtccggttcccaaggtgagcatcaccgatcctaacctggtcagggaggtcatgtccaacaagtttgggcacatccagaaggtcaagttcccggcgctgtccaagctcctcgccgtgggcgtggccacccacgagggcgagaaatgggtcaagcacagaaggatactcaaccctgcgttccatgtcgagaagctcaagatcatgttgcccgccttctctttgtgttgtgaagagcttgttaacaaatggacacagtcccttggtcccgacggctcgtgtgaggtggatgtttccttagaactccagagcctcaccggagatgtcatctcacgcaccgcattcggcagcagttatctcgaaggaagaaggatttttcaactccagtctgagcaggtcgggcggttcatggcagccattcacaagattatgattcccggttacatgtccttccctactaaaaataatcgaaggatgcgtcaaattaacaacgagatagagtccattctacgaggtctaattgggaaaaggatgcaagctatgcaaggagagagcacaaacgatgacttactcggcttattgctggagtcaaacaagacagacatgaatgaaaatggccaatccattcctggaatgtccatagaagaggtaatagaggagtgcaagttgttctactttgcaggaatggagacgacatcaatattactcacatggacgatggtcgtacttagcatgcacccagagtggcaggaccgtgcaagggaggaggttcttggcctatttggaaaacataagcttgactacgagggtcttaatcgactcaaaaccgtgacaatgattctttatgaagttctccggttgtacccaccggctagtgcgttcacccgacagacatacaaggagattgagatcggaggcgtcacatacccgcctggcgtgattttcgagatgtccgtgctgcacatccaccacgacaaggacatctggggagacgacgtgcaccaattcaggcccgataggttcgcggaggggatctccaaggcgtccaaggaaccgggaggatttttccctttcggatgggggccacggatctgcatcggtcagaattttgcactgcttgaggccaagatggcattgtgcatgattcttcggcgttttgagtttgagctcgccccgtcgtatacacatgcgccacataccgtaatgatgttgcgtcccatgcatggtgctcaaattaagctacaggcgacctcttcgtagtagtatcaccatatacacatatttcagaacatatttgtttttgagaatgattcactctacatgtatcatatgcactcttatcttggccatgtaaaaaggctttccttgccttctatcgtaataaaggtccaacatgatttagggccatgatggctcatctgtttgtactctttgaccaaa

SEQ ID NO: 206 - DNA, 1691 bp, Triticum aestivum
cagcactaccatggagctacctcgcctgcggcctcttgggcctggcgctcctgtggccgaccacccggctgctagaccagctatggtggcggccgaggcggctggagcgggctcttcgcgcccagggccttcgtgggacgtcgtacagtttcctcctcggcgacatgagcgactacggcaggcagaacaaggaggcgtggtcgaagcctctgccgctgcgctgccacgacatcggtgcccacgtcttgcctttcctctacagcaccgtcgaggagcacggcaagcagtgcatctcctggttcggtccggttcccaaggtgagcatcaccgatcctaacctggtcagggagatcatgtccaacaagtttgggcacatccagaaggtcaagttcccggcgctgtccaagctcctcgccgtaggcgtggcgacccacgagggcgagaaatgggtcaagcacagaaggatactcaaccctgcgttccatgtcgagaagctcaagatcatgttgccagccttctctttgtgttgtgaagagcttgtcaacaaatgggcacagtcccttggtcccgacggctcgtgtgaggtggatgcttccttagagctccagagcctcaccggagatgtcatctcacgcaccgcattcggcagcagttatctcgaaggaagaaggatttttcaactgcagtctgagcaggtcggacggttcatggcagccattcacaagatcatgattcccggttacatgtccttccctactaaaaataatcgaaggatgcgccaaattaacaacgagatagagtccattctacgaggtctaattgggaaaaggatgcaagctatgcaagaaggagaaagcacaaatgatgacttactcggcttattgctcgagtcaaacaagactgacgtaaatgaaaatggccaatccgttccaggaatgtccactgaagaggtaatagaggagtgcaagctgttctactttgcaggaatggagacaacatcaatattactcacatggacgatggtggtacttagcatgcacccagagtggcaggaccgtgcaagggaggaggttcttggcctatttggaaaacataagcttgactacgagggtcttaatcgactcaaaactgtgacaatgattctttatgaagttctccggttgtacccaccggctagtgcgttcacccggcagacatacaaggagattgagatcagaggcatcaggtacccacctggtgtgattttcgagatgtccgtgttgcacatccaccacgacaaggatatctggggagacgacgtccaccaattcaggcccgataggttcgctgaggggatctccaaggcttccaaggaaccgggagcatttttcccgttcggatgggggccacggatctgtatcggtcagaattttgcactgcttgaggccaagatggcattgtgcatgattcttcggcgctttgagtttgagctcgcgccgtcgtatactcatgcgccacataccgtaatgatgttgcgtcccatgcatggtgctcaaattaagctgcgggcgatctcttcgtagtagtatcgccatatatacattattcactacatattattattttcaagtacaaaggactcttatcttggccatgtaataaggctttattgccttctgtatttggtaataaaggtccaacatgatttaggg

SEQ ID NO: 207 - DNA, 1795 bp, Secale cereale
aatgaatccggaatcggtattgatgactccagcagcactgccatggagctacctcgcctgcggcctcttgggcctggcgctcctgtggccgaccacccggctgctcgaccggctgtggtggcggccgaggcggctggagcgggctctccgcgccaagggccttcgcgggacgtcgtaccgtttcctcctcggcgacatgagcgactacggccggcagaacaaggaggcgtggtccaagcccctgccgctgcgctgccacgacatcggcgcacacgtcatgcctttcctctacagcaccgtccagcagcacggcaggcggtgcatctcctggttcggtccggtccccaaggtgagcatcaccgatcctagcctggtcagggagatcatgtccaacaagtttgggcacatccacaaggtcaagttccccgcgctggccaagctcctcgccataggcgtggccacccacgagggcgagaaatgggtcaagcacagaaggatactcaaccctgccttccatgccgagaagctcaagatcatgttgcccgccttctctttgtgttgtgaagagcttgttaacaaatggacacggtcccttggccccgacggctcgtgtgaggtggacgcttccttagagctccagagcctcaccggagatgtcatctcacgcaccgcattcggcagcagttatctagaaggaagaaggatttttcaactgcagtctgagcaggtcgggcgattcatggcagccattcacaagatcatgatccccggttacatgtccttccctactaaaaataatcgaaggatgcgtcaaattaacaacgagatagagtccattctacgaggtctaattgggaaaaggatgcaagctatgcaagaaggagaaagcacatatgatgacttactcggcttattgctcgagtcaaacaagacagacatgaatgaaaatggccaatccattccaggaatgtccatagaagatgtaatagaggagtgcaagctgttctactttgcaggaatggagacaacatcaatattactcacatggacgatggtcgtgcttagcatgcacccagagtggcaggaccgtgcaagggaggaggttcttggcctatttggaaaacataagcttgactacgagggtcttaatcgactcaaaaccgtgacaatgattctttatgaagttcttcggttgtacccaccggctagtgcattcacccggcagacatacaaggagattgagatcggaggcgtcacatacccgcctggcgtgatttttgagatgtccgtgttgcacatccaccacgacaaggacatctggggagacgatgtgcaccaattcaggcccgataggttcgcggaggggatatccaaggcgtccaaggaacctggagcatttttcccgttcggatgggggccacggatctgtatcggtcagaattttgcactgcttgaggccaagatggcattgtgcatgattcttcagcgctttgagtttgagctcgcgccatcgtatactcatgcgccacataccgtaatgatgttgcgtcccatgcatggtgctcaaattacgctacggccgatctcttcatagtaatatcgccatatatacattattcactacatatttatatttcgagaatggtccactacatgtacactcttatcttggccatgtaataaggttttcattgccttctgtatttggtaataacggtgcaacatgatttagggccatgatagctcatctgtttgtactctttgaccaaacgtatctatggtgccaatccaaaaa

SEQ ID NO: 208 - DNA, 1699 bp, Secale cereale
caacaatgaatccggaatcggtattgactccagcagcactgccatggagctacctcgcctgcggcctcttgggcctggcgctcctgtggccgaccacccggctgctcgaccggctctggtggcggccgaggcgcctggagcgggctctccgcgccaagggccttcgcgggacgtcgtaccgtttcctcctcggcgacatgagcgactacggccggcagaacaaggaggcgtggtccaagcccctgtcgctgcgctgccacgacatcggcgcacacgtcatgcctttcctctacagcaccgtccagcagcacggcaggcggtgcatctcctggttcggcccggtccccaaggtgagcatcaccgatcctaacctggtcagggagatcatgtccaacaagtttgggcacatccacaaggtcaagttccccgcgctggccaagctcctcgccataggcgtggccacccacgagggcgagaaatgggtcaggcacagaaggatactcaaccctgccttccatgtcgagaagctcaagatcatgttgcccgccttctctttgtgttgtgaagagcttgttaacaaatggacacggtcgcttggccccgacggctcgtgtgatgtggacgcttccttggagctccagagcctcaccggagatgtcatctcacgcaccgcattcggcagcagttatctcgaaggaagaaggatttttcaactgcagtctgagcaggtcgggcgattcatggcagccattcacaagatcatgattcccggttacatgtccttccctactaaaaataatcgaaggatgcgtcaaattaacaacgagatagagtccattctacgaggtctaattgggaaaaggatgcaagctatgcaagaaggagaaagcacatacgatgacttactcggcttattgctcgagtcaaacaagacaaacatgaatgaaaatggccaatccattccaggaatgtcaatagaagatgtaatagaggagtgcaagctgttctactttgcaggaatggagacaacatcaatattactcacatggacgatggtcgtgcttagcatgcacccagagtggcaggaccgtgcaagggaggaggttcttggcctatttggaaaacataagcttgagtatgagggtcttaatcgactcaaaaccgtgacaatgattctttatgaagttcttcggttgtacccaccggctagtgcgttcacccggcagacatacaaggagattgagatcggaggcgtcacatacccgcctggcgtgattttcgagatgtccgtgttgcacatccaccacgacaaggacatctggggagacgatgtgcaccaattcaggcccgataggttcgcggaggggatatccaaggcatccaaggaaccgggagcatttttcccgttcggatgggggccacggatctgtatcggtcagaattttgcactgcttgaggccaagatggcattgtgcatgattcttcagcgctttgagtttgagctcgcgccggcgtatactcatgcgccacataccgtaatgatgttgcgtcccatgcatggtgctcaaattaagctacgtgcgatctcttcgtagtaacatcgccatatatttattattcactatatatatatttcgagaatggtccactacatgtatcatatgcactcttatcttggccatgtaataaggtttccatt

SEQ ID NO: 209 - DNA, 1677 bp, Secale cereale
tgactccagcagcactgccatggagctacctcgcctgcggcctcttgggcctggcgctcctgtggccgaccacccggctgctggaccggctgtggtggcggccgaggcggctggagcgggctctccgcgccaagggccttcgcgggacgtcgtaccgtttcctcctcggcgacatgagcgactacggccggcagaacaaggaggcgtggtccaagcccctgccgctgcgctgccacgacatcggcgcacacgtcatgcctttcctctacagcaccgtccagcagcacggcaggcggtgcatctcctggttcggtccggtccccaaggtgagcatcaccgatcctaacctggtcagggagatcatgtccaacaagtttgggcacatccacaaggtcaagttccccgcgctggccaagctcctcgccataggcgtggccacccacgagggcgagaaatgggtcaggcacagaaggatactcaaccctgccttccatgtcgagaagctcaagatcatgttgcccgccttctctttgtgttgtgaagagcttgttaacaaatggacacggtcccttggccccgacggctcgtgtgaggtggacgcttccttagagctccagagcctcaccggagatgtcatctcacgcaccgcattcggcagcagttatctagaaggaagaaggatttttcaactgcagtctgagcaggtcgggcgattcatggcagccattcacaagatcatgattcccggttacatgtccttccctactaaaaataatcgaaggatgcgtcaaattaacaacgagatagagtccattctacgaggtctaattgggaaaaggatgcaagctatgcaagagggagaaagcaaaaacgatgacttactcggcttattgctcgagtcaaacaagacaaacatgaatgaaaatggccaatccattccaggaatgtcaatagaagatgtaatagaggagtgcaagctgttctactttgcaggaatggagacaacatcaatattactcacatggacgatggtcgtgcttagcatgcacccagagtggcaggaccgtgcaagggaggaggttcttggcctatttggaaaacataagcttgactacgagggtcttaatcgactcaaaaccgtgacaatgattctttatgaagttcttcggttgtacccaccggctagtgcgttcacccggcagacatacaaggagattgagatcggaggcatcacgtacccgcctggcgtgattttcgagatgtccgtgttgcacatccaccacgacaaggacatctggggagacgatgtgcaccaattcaggcccgataggttcgcggaggggatatccaaggcatccaaggaaccgggagcatttttcccgttcggatgggggccacggatctgtatcggtcagaattttgcactgcttgaggccaagatggcattgtgcatgattcttcagcgctttgagtttgagctcgcgccggcgtatactcatgcgccacataccgtaatgatgttgcgtcccatgcatggtgctcaaattaagctacatgcgatctcttcgtagtaacatcgccatatatttattattcactatatatatatttcgagaatggtccactatatgtatcatatgcactcttatcttggccatgtaataaggtttccattgc

SEQ ID NO: 210 - DNA, 1742 bp, Aegilops tauschii
attcagagttctgaatgccaatccaatccattccaatttccaagcacgcccacgagagggaagcaatgaatcttgaatcggtactgagtccagcagcactaccgtggagctacctcgcctgcggcctcttgagcttggcgctcctagtcctatggccaaccacccggctgctagagcagctatggtggcggccgaggcgcctggaacgggctcttcgcgcccagggccttcgtgggacgtcctacagtttcctcctcggcgacatgagcgactacggcaggcaaaacaaggaggcgtggtccaagcccctgccgctgcgctgccacgacatcggcgcacacgtcatgcctttcctctacagaaccgtccaggagcacggcaagcagtgcatctcctggttcggtccggttcccaaggtgagcatcaccgatcctaacctggtcagggaggtcatgtccaacaagtttgggcacatccagaaggtcaagttcccggcgctgtccaagctcctcgccgtgggcgtggccacccacgagggcgagaaatgggtcaagcacagaaggatactcaaccctgcgttccatgtcgagaagctcaagatcatgttgcccgccttctctttgtgttgtgaagagcttgttaacaaatggacacagtcccttggtcccgacggctcgtgtgaggtggatgtttccttagaactccagagcctcaccggagatgtcatctcacgcaccgcattcggcagcagttatctcgaaggaagaaggatttttcaactccagtctgagcaggtcgggcggttcatggcagccattcacaagattatgattcccggttacatgtccttccctactaaaaataatcgaaggatgcgtcaaattaacaacgagatagagtccattctacgaggtctaattgggaaaaggatgcaagctatgcaaggagagagcacaaacgatgacttactcggcttattgctggagtcaaacaagacagacatgaatgaaaatggccaatccattcctggaatgtccatagaagaggtaatagaggagtgcaagttgttctactttgcaggaatggagacgacatcaatattactcacatggacgatggtcgtacttagcatgcacccagagtggcaggaccgtgcaagggaggaggttcttggcctatttggaaaacataagcttgactacgagggtcttaatcgactcaaaaccgtgacaatgattctttatgaagttctccggttgtacccaccggctagtgcgttcacccgacagacatacaaggagattgagatcggaggcgtcacatacccgcctggcgtgattttcgagatgtccgtgctgcacatccaccacgacaaggacatctggggagacgacgtgcaccaattcaggcccgataggttcgcggaggggatctccaaggcgtccaaggaaccgggagcatttttccctttcggatgggggccacggatctgcatcggtcagaattttgcactgcttgaggccaagatggcattgtgcatgattcttcggcgttttgagtttgagctcgccccgtcgtatacacatgcgccacataccgtaatgatgttgcgtcccatgcatggtgctcaaattaagctacaggcgacctcttcgtagtagtatcaccatatacacatatttcagaacatatttgtttttgagaatgattcactctacatgtatcatatgcactcttatctt

SEQ ID NO: 211 - DNA, 1762 bp, Avena sativa
tgccttgcctcccacgactagttgtgacccaacattaccaatccactccgggtgcacatcattgacttgcattcttctctctccaacttctctacggagaaatggttcttgaatctttgctgggttcagctgcttctgtgccatggagcttcctgctctgcggcctcttgggcatggtgcttctgtggccaacgatccgactgctagagcagctgtggtggcagccaaggcggctggagcgggctcttcgcgcccagggtctccgcggcacgccgtaccgtttcctcatcggcgatgtcaacgactacggccggcaaaacaaggagtcctggtcgaagcctctgccgctgcgctgccacgacatcggcgcccacgtcatgcctttcctctataacactgtcgaggagtacggcaagccttgcatctcctggttcggtccgatgcccaaggtgaccatcaccgatcccaacctggtcaaggaggttatgtccaacaagtttggccacatcgagaagctcaagttcccagcgttatccaagctcctcgccgtaggcgtcgccaaccacgagggcgagaaatgggtcaagcacaggaggatactcaaccctgcgttccatgtcgagaagctcaagctcatgctgcccgcctttgctgcgtgttgtgaagagcttgttagcaggtggacagaatctcttggacctgacggctcgtgggaggtggatgtctcctcagagctgcagaacctcaccggggatgtcatctcacagaccgcattcggtagcagttatctggaaggaagaaggatttctcaactgcagtccgagcagatggggagattcatggcagccattcacatgattgtcatacccggttacatgtcctttcctaccaaaaacaaccgaaggatgcatcaaattaataacgagattgagaacattctacgaagcctaatttcgaagaggatgcaagcaatccaggaaggggaaagcacgaaagatgacttactcggcttattgctgcagtcaaacatgacaagcacagatgcaaatggtaaaaccgtcctaggaatgtcaagagacgaagtcatggaggagtgcaagttgttctattttgcaggaatggagacaacatcggtattgcttacatggacaatgatcctacttagcatgcaccccgagtggcaggaccgtgcaagggaagaggttcttggcctatttggaaagcataaacttgagtatgagggtgtcagtcgactcaaaatcgtgacgatgattctttacgaggttctccggttgtacccaccagctactgcgctcacccgaaagacatacaaggagattgagatcggaggcatcacataccctgctggcgtggtcttcgagctgcccgtgttgttccttcaccatgacccagacatttggggaaacgacgtgcaccagttcagaccagataggttcgcggaggggatctccaaggcctccaaggaaacgggcgcattcttcccgttcggttgggggccacgtatctgtattggtcaaaactttgcgttgcttgaggccaagatggcattgtgcatgatccttcaacgctttgagtttgagctagcatcctcgtatgcccatgcaccgcataccgtgatgatgatgcgtcctatgcatggtgctcaaattaagctacgggctatctcttcatagtattctcacacacatggtattcactacctatatcacagatatctattgcttttgccttttgtaatacg

SEQ ID NO: 212 - DNA, 1932 bp, Aegilops tauschii
atgaatcttgaatcggtactgagtccagcagcactaccgtggagctacctcgcctgcggcctcttgagcttggcgctcctagtcctatggccaaccacccggctgctagagcagctatggtggcggccgaggcgcctggaacgggctcttcgcgcccagggccttcgtgggacgtcctacagtttcctcctcggcgacatgagcgactacggcaggcaaaacaaggaggcgtggtccaagcccctgccgctgcgctgccacgacatcggcgcacacgtcatgcctttcctctacagaaccgtccaggagcacggcaagcagtgcatctcctggttcggtccggttcccaaggtgagcatcaccgatcctaacctggtcagggaggtcatgtccaacaagtttgggcacatccagaaggtcaagttcccggcgctgtccaagctcctcgccgtgggcgtggccacccacgagggcgagaaatgggtcaagcacagaaggatactcaaccctgcgttccatgtcgagaagctcaaggtacctacctacctgcaggttgcccctctttttgatagccgttgtggcaagtgtgtgactaattcgcttgatttgcagatcatgttgcccgccttctctttgtgttgtgaagagcttgttaacaaatggacacagtcccttggtcccgacggctcgtgtgaggtggatgtttccttagaactccagagcctcaccggagacgtcatctcacgcaccgcattcggcagcagttatctagaaggaagaaggatttttcaactgcagtctgagcaggtcgggcgtttcatggcagccattcacaagatcatgattcccggttacatgtccttccctactaaaaacaatcgaaggatgcgtcaaattaacaatgagatagagtccattctacgaggtctaattgggaaaaggatgcaagctatgcaaggagaaagcacaaacgatgacttactcggcttattgctggagtcaaacaagacagacatgaatgaaaatggccaatccattcctggaatgtccatagaagaggtaatagaggagtgcaagttgttctactttgcaggaatggagacgacatcaatattactcacatggacgatggtcgtacttagcatgcacccagagtggcaggaccgtgcaagggaggaggttcttggcctatttggaaaacataagcttgactacgagggtcttaatcgactcaaaaccgtgacaatgattctttatgaagttctccggttgtacccaccggctagtgcgttcacccgacagacatacaaggagattgagatcggaggcgtcacatacccgcctggcgtgattttcgagatgtccgtgctgcacatccaccacgacaaggacatctggggagacgacgtgcaccaattcaggcccgataggttcgcggaggggatctccaaggcgtccaaggaaccgggagcatttttccctttcggatgggggccacggatctgcatcgacggtgttcaagctggtggttggaggctcaaacgtgcttggatcgaccccaaacttggtgagctcgttccttactttgagtacttcgatctggttagctggtttgaggattgggtcagtggagcatcagatttgagagtgattttgtcagctctgactgctgcagtttcagaacagagtagttttgggagacgaacagtttgggtaggcaaacgatgtccgattgagctgaaatttggaggggatctcaagaactcgtgtgtctacttgtctgccaaatttggtgctgtttggttcagcggtttaagagcagtttgcaaaacactgaagggtacagaagctgtaaactctgctttgctgaaatgttgcctctcgtggatgttgttgctgttgccggttggcaacatggagagtgtgttgtaa

SEQ ID NO: 213 - DNA, 1302 bp, Secale cereale
cttcaaacccagctgatcaccagctagcagcatttccctccccgcactcggtacccccgattgcccgtcgtcccagctccaggcagccgcggtagccatgggcaccctcgtcggccacgtcgcgccgggcgccggcttcctcctcatcggcctgtggcagctgttcaaccacatccggctgttcgcgctgcggcccagctcctacgccgcgccggtctggttccccgcgcgcggcgtccgccacctcgagctcatcctcatcatcgtcggcacggcggcgtccatcctgatggagctcgtcatcgggcccgcgaagcaccagccttttgacgacgacggcaccatcccgtccgaccacctccacaacttcgagcacgcgtccatctcgctcgcgctgctcgccttcgccgcggtcaccatccacatggacagggtccgggcgcccatgcgggacgccgtgtcgcagctggtcgccgccgcggcgttcgcgcaggagctgctcgtcttccacctccactccacggaccacatgggcgtggaggggcagttccactggctgctgcagaccgtcatcgccgtcacgctggccaccacggtgctgggcatcccgtacccgcggagcttcgtggtgagcctggtcaggtcgggcgagcctcgtagctccagggtgtgtggttcatcgtcatgggcgtcatgctctggacgccggggctcgtctccaaggggtgcttcctcaatcacgaggacggccacgacgtggtccgctgccgcaccgacgaggcgctccaccgcgccaaggcgctggtcaacctgcagttcagctggtacctgacgggcaccctggtgttcgtcgtcgtgctctacctccaggtcagtaggctgtaccccgaggagccgcagtacttgccgctggtcaagggaggacacgccggccgccggttcagcatcggggacgataacgatgacgatgacgacgaggatgacctggaggccgcgaagcgtggctacgggcacgtggtcagcggtggcacaacacccatggaggtggagaggtaaacccatggagtatgaacgaagggaacggtcaagatgcatggtcgtatattggtattgcattggagatatgttcagtaggattggggtgctgtagattgtatagttctttcacttttgtggatttggtttcaccgagtgaactgacccgtaaatgcgggtcaagttcgtgcctggtcactttaatttgtttatttagcctagcttgttgttttgatcatcggagtacaatggattcagggttggctt

SEQ ID NO: 214 - DNA, 1454 bp, Triticum aestivum
ccgcactctgtatccccgattgtccgtcgcagctcctcgcagccgccgtagccatgggcaccctcgtcggccacgtcgcgccgggcgccggcttcctcctcatcggcctgtggcagctgttcaaccacatccggctgttcgtgctgcggcccggctcctacgccgcgccgctctggttccccgcgcgcggcgtccgccacctcgagctcatcctcatcatcgccggcacgtcggcgtccatcctgatggagctcgtcatcggccccgcgaagcaccagccgttcgacgacgacggcaccatcccgtccgaccacctccacaacttcgagcacgcgtccgtctcgctcgccctgctcgcgttcgccgcggtcaccatccacatggacagggtccgggcgcccatgcgggacgccgtgtcgcagctggccgccgcggcggcgttcgcgcaggagctgctcgtcttccacctccactccacggaccacatgggcgtggaggggcagttccactggctgctgcagaccgtcgtcgccgtcacgctggccaccacgctgctgggcattccgtacccgcggagctttgtggtgagcctggtcaggtcggcgagcctcgtgctccagggcgtgtggttgatcgtcatgggcgtcatgctctggacgccggggctcgtccccaaggggtgcttcctgaatcacgaggacggccacgacgtggtccggtgccgcaccgacgaggcgctccatcgcgccaaggcgctggtgaacctgcagttcagctggtacctgacgggcaccatggtgttcgtcgtcgtgctctacctccaggtcagcaggctgtaccccgaggagccgcagtacttgccgctggtcaagggaggaccctccggcggccggttcagcgtcggggacgatgacgaggacgatgacgacgaggatgacctggaggccacgaagcgtggctacgggcacgtggtcagcggtggcacaaaacccatggaggtagagaggtaaaactgaagccgtatgccgtgtgaacgatgaacggagggaacggtcaagatgcagtgtcgtatgttacagtgggtatatgttcagtaggattggtgtgctgtagattgtatagttttttcacttttgtggatttggtttcaccgagtgaactgacccgtaaatgtcgtcgttggtcacttcaatttgtttgtttagccctggcttgttggtctgatcatcggagtactacaatggattcatggctggcctgtggatggagagtgggcttgcaccttttgtgtgtcttcttgattgatgattgtaccttaaagcttgccgtaaatgacttcttttaggcccggcagtcgtccccggcgctttcattcctcgctctcttttctcatcaacctacgagtccaatccattgtgtcgccttcggtgttactagatcataatggcgcgcgt

SEQ ID NO: 215 - DNA, 1617 bp, Aegilops tauschii
aacacatcactgctgaagtgctgccgatggaggttgtccaaatccatttgtatgtaaaataagagaacttttcaaaccttgcaagccaccggaactctccagagagtcgaccatccaaccttcttaaaccccatgggccatggttcccatcaaccattcaaactccaaacgcagctccagcatttaaatttcccacctccccgcactctgcatccccgattgcccgtcgcagctcctcgcagccgccgtcgccatgggcaccctcatcggccacgtcgcgccgggcgccggcttcctcctcatcggcctgtggcagctgttcaaccacatccggctgttcgtgctgcggcccagctactacgccgcgccgctctggttccccgcgcgcggcgtccgccacctcgagctcatcctcatcatcgtcggcacgtcggcgtccatcctgatggagctcgtcatcggccccgcgaagcaccagccgttcgacgacgacggcaccatcccgtccgaccacctccacaacttcgagcacgcgtccgtctcgctcgcgctgctcgcgttcgccgcggtcaccatccacatggacagggtccgggcgcccatgcgggacgccgtgtcgcagctggccgccgccgcggctttcgcgcaggagctgctcgtcttccacctccactccacggaccacatgggcgtggaggggcagttccactggctgctgcagaccgtcatcgccgtcacgctggccaccacgctgctgggcatcccgtacccgcggagcttcgtggtgagcctggtcaggtcggcgagcctcgtgctccagggcgtgtggttgatcgtcatgggcgtcatgctctggacgccggggctcgtctccaaggggtgcttcctcaatcacgaggacggccacgacgtggtccagtgccgcaccgacgaggcgctccaccgcgccaaggcgctggtcaacctgcagttcagctggtacctgacgggcaccatggtgttcgtcgtcgtgctctacctccaggtcagcaggctgtaccccgaggagccgcagtacttgccgctggtcaaggggagacacgccggcggccgggtcagcatcggggacgatcgcgaggacgatgacgacgaggaggacctggaggccacgaagcgtggctacgggcacgtggtcagcggtggcacaaaacccatggaggtagagaggtaaaactgaagccgtatgccgtgtgaacgatgaacggagggaacggtcaagatgcagtgtcgtatgttacagtgggtatatgttcagtaggattggtgtgctgtagattgtatttttttttcacttttgtggatttggtttcaccgagtgaactgacccgtaaatgcgggtgaagttcgtggttggtcactttgatttgtttattatttaacctagcttgttgttctgatcatcagagtacaatggattcagggttggcctgtggatggagagtggacttgcaccttctttttttttttctttttgcgttcttgatgattgtaccttaaagcttgccgtaaatgacttcttctaggcccgtcagtcgtcgccggcgctttcattcgtcgctgtcttttctcagcaacctg

SEQ ID NO: 216 - DNA, 1273 bp, Panicum virgatum
ttgcgccggtgcacgcaacgccaaaggccaaagcgcttcgggggcgggcgcgccatgggcaccctcgtcgggcacgtcgcgccgggcgccggcttcctcctcatcggcctgtggcagctgttcagccacatccgcctcttcctgctgcggccgagctcgtactcggcgccggtctggttcccggcgcgcggcgtgcgccaccttgagctcatactcataatcgtcggcacggtgatctccatcctgatggagctcgtcatcggcccggagaagcaccagccgttcgacgacgacggcaccatcccgtccaaccacctccacaacttcgagcacgcgtccatctcgctggcgctgcttgtcttcgccgcggtcaccatccacatggaccgggtgcgggcgccgatgcgggacgcggtgtcgcagctggtggccgccgcggcgttcgcgcagcagctgctcatcttccacctccactcggcggaccacatgggcgtggagggccagttccactggctgctgcagaccgtcatcgccgtcacgctcgccaccacgctcctcggcatcccctacccgcggagcttcacggtgagcctggtccggtcggcgagcctcgtgctccagggcgtctggttcatcgtcatgggaatcatgctctggacccccgcgctcatccccaagggctgcttcctcaacctcgaggaaggccacgacgtggtccggtgccgcacggacgaggcgctcgaccgtgccaagtcgctcgtcaacctgcagttcagctggtacctcaccggcaccgtggtgttcgtcgtcctgttctacctccatatggctaagctctacccggaggagccgcagtacttgccgctggtaaagggcggcggcggcggcggcgacagcgacagccggttcagcataggagatgaccacgacgacgaggacgaccttgaggccgccaagcgtggcttcgggcacgtggtgagcggcacaaagcctgtcgaaatcgagaggtgaaatcgtagcaccgtaaggttgggaaacgttctttctgtgattacagtgtggtttggcttcagtgtttgtggtcagaaatgtacaattgtattctttagggaaccgtgcaaaaagcggtttacagctgatagatacactgcgacccttggattaaggatccaatggcaagtccatatttgtcctgtctcaggtcatccacatctctctctgttctaaccaagatcgggagaaatttgcaaaaatggaaccgcaagcattggca

SEQ ID NO: 217 - DNA, 1281 bp, Panicum virgatum
ccctctccacacgccaccaccaactctttcctcctgttcgtaccactcacgccggtgcacgcaacgccaaaggccaaagctctcgggggcggcgcgccatgggcaccctcgtcgggcacgtcgcgccgggcgccggcttcctcctcatcggcctgtggcagctgttcagccacatccgcctcttcgtgctgcggccgagctcgtactcggcgccggtctggttcccggcgcgcggcgtgcgccaccttgagctcatactcataatcgtcggcacggtgatctccatcctgatggagctcgtcatcggcccggagaagcaccagccgttcgacgacgacggcaccatcccgtccaaccacctccacaacttcgagcacgcgtccatctcgctggcgctgctcgtcttcgccgcggtcaccatccacctcgaccgggtgcgggcgccgatgcgggacgcggtgtcgcagctggtggccgccgcggcgttcgcgcagcagctgctcatcttccacctccactcggcggaccacatgggcgtggagggccagttccactggctgctgcagaccgtcatcgccgtcacgctcgccaccacgctcctcggcatcccctacccgcggagcttcacggtgagcctggtccggtcggcgagcctcgtgctccagggcgtctggttcatcgtcatgggaatcatgctctggacccccgcgctcatccccaagggctgtttcctcaacctcgaggaaggccacgacgtggtccggtgccgcacggacgaggcgctcgaccgtgccaagtcgctcgtcaacctgcagttcagctggtacctcaccggcaccgtggtgttcgtcgtcctgttctacctccatatggctaagctctacccggaggagccgcagtacttgccgctggtaaagggcggcggcggcggtggcgacagcgacagccggttcagcataggagatgaccacgacgacgaggacgaccttgaggccgccaagcgtggcttcgggcacgtggtgagcggcacaaagcctgtcgaaatcgagaggtgaaatcgtagcaccgtaagtttgggaaacgttctttctgtgattacagtgtggtttggcttcagtgtttgtggtcagaaatgtacaattgtattctttagggaaccgtgcaaaaagcggtttacagctgatagatacactgcgacccttggattaaggatccaatggctagtccatatttgtcctgtctcaggtcatccacatctctctctgttctaaccaagatcgg

SEQ ID NO: 218 - DNA, 1323 bp, Sorghum bicolor
agaccttcttaaaccccccaatatccccccatcagccccttcaaccttcaaagttcaaacctccacacgccaccaccaccaccaacttcttccctgctaggctgtccactcccgctggtgcacgcaaaagccacagcgcgcgcggcggcacgccatgggcactctcgtcgggcacgtcgcgccgggcgccggcttcctcctcatcggcctgtggcagctattcagccacatccgcctgttcctgctgcgcccgagctcgtactctgctccggtctggttcccggcgccgggcgtgcgccacctcgagctcatactcatcatcatcggcgcggcgatgtccatcctgatggagctcgtcatcggccccgcgaagcaccagccgttcgacgacgacggcaccatcccgtcagaccacctccacaacttcgagcacgcgtccatctcgctggcgctgctcgtcttcgccgcggtcaccatccacctcgacagggtaaaggcgcccctgcgtgacgccgtgtcgcagctcgtcgccgccgcggcgttcgcgcagcagctgctcatcttccacctccactcggcggaccacatgggcgtggaggggcagttccactggctgctgcagacggtcatcgccgtcacgctcgccaccacgctgctcgggatcccttacccgcggagcatcgtggtgagccttgtccggtcggccagcctcgtgctccagggcgtctggttcgtcgtcatgggcgtcatgctgtggacgccggcgctcatacccaagggctgcttcctcaacctcgaggaagggcacgacgtcgtccggtgccgcaccgacgaggcgctcgaccgcgccaagtcgctcgtcaacctgcagttcagctggtacctcaccggcacggtggtgttcgtcgtcctgttctacctccagatggcgaagctctaccccgaggagccgcagtatttgccgctggtgaagggaggaggcggcggcggcgatgaccgcgatagccggttcagcatcggagacgatgatcacgacgatgaggacgatgtcgaggctgcaaaacgtggcttcggacacgtggttagcggcacaaagcctgtcgaaatcgagaggtgaggtcgtacgccgtagcaccgtaaggttaggttgttgttgtgtgtgattacagtacagtgtaatttgacttcaacgtttgttggtgaaaaacatgcaaatatttgtatagggagattctattattttactactggtctattgttgataacttcgtgatccttatggattaagaatcccacggcggcccatgtttattgtacctcaag

SEQ ID NO: 219 - DNA, 1622 bp, Setaria italica
ccccctgcaggaacaacacccttcgaccttcaaaccttccctctccacacgccaccaccaccaccttcttttccttctgtccgcctgtccgtaccactcgccctggtgcacgcaaagccagagcgcggcggcacgccatgggcaccctcgtcgggcacgtcgcgccgggcgccggcttcctcctcatcggcctatggcagctgttcagccacacccgcctcttcttgctgcggccgagctcgtactcggcgccggtctggttcccggtgcgcggcgtgcggcacctcgagctcatcctcataatcatcggcaccgtgatctccatcctgatggagctcgtcatcggccccgctaagcaccagcccttcgacgacgacggcaccataccgtccgaccacctccacaacttcgagcacgcgtccatctcgctcgcgctgctcaccttcgccgcggtcaccatccacctcgacagggtgaaggcgccgatgcgtgacgcggtgtcgcagctcgtggccgccgcggcgttcgcgcagcagctactcatcttccacctccactcggcggaccacatgggcgtggagggccagttccactggctgctgcagacggccatcgccgtcacgctcgccaccacgctcctcggcatcccctaccctcggagcttcacggtgagcctggtccggtcggcgagcctcgtgttccagggcgtctggttcatcgtcatgggcgtcatgctgtggacgcccgcgctcatccccaaggggtgcttcctcaaccgagaggaaggccacgacgtcgtccggtgccgcaccgacgaggcgctcgaccgcgccaagtcgctcgtcaacctgcagttcagctggtacctcaccggcaccgtggtgttcgtcgttttcttctacctgcagctcaccaagcgctaccccgaggagccgcagtacttgccgctggtaaaaggtggcggcggcggcggcgacagcgacggccggttcagcatcggagatgaccacgacgacgaggacgatctcgaggtcgcgaaacgtggcttcgggcacgtggttagcggcacaaagcctatcgaaatcgagaggtgaggtcgccgcaccgtacgcacggttaggattgttctgtgattatcgtgtaatttggctttagtgtttgtggtgaaaaatgtacaattattctttagaaaaccgttacaaagaacggtttacagttggtactacgaaagtactttgtaaattgtgacccttggagtacggatccaatggtagcccatgtctgtccctcctcgctaggcgttgtcacgcgcgcaacaatggcaatcattgtaatcgccaatattttcagttgacaacgcaatctaccccacaaagcatttatggaggcggctagaacaggtttgtactgacgggtatcgcacccgtcagcaactttgagtcagcacaaatgccgtctgtgctggtgggtgctcgtccgccagcacagactgctctttgcaggcggactacattagccacccaccagcacagatgctttctgtgctgacggtgtggttacgccgcccgccactaatatgtattttcccattcaatatattattttctatgagttatttataa

SEQ ID NO: 220 - DNA, 1204 bp, Panicum virgatum
aaaccttcttaaacccccagccccaggtttcccttcaaccttcaaaccttccctctccacacgccaccaccaacttctttcctcctgtccgaaccgcgcttgcgcaggtgcacgcaacgccaaaaggccaaagctcttcggcggcgcgccatgggcaccctcgtcgggcacgtcgctccgggcgccggcttcctcctcatcggcctgtggcagctgttcagccacacccgcctcttcctgctgcggccgggctcgtacacggcgccggtctggttcccggcgcgcggcgtgcgccacctcgagctcatactcatcatcgtcggcacggtgatctccatcctgatggagctcgtcatcggccccgcgaagcaccagccgttcgacgacgacggcaccatcccgtccgaccacttgcacaacttcgagcacgcgtccatctcgctggcgctgctcgtcttcgccgcggtcaccatccacctcgaccgggcgtgggcgccgatgcgggacgccgtgtcgcagctggtggccgccgcggcgttcgcgcagcagctgctcatcttccacctccactcggcggaccacatgggcgtggagggccagttccactggctgctgcagaccgtcatcgccgtcacgctcgccaccacgctgctcgggatcccctgcccgcggagcttcacggtgagcctggtccggtcggcgagcctcgtgttccagggcgtctggttcatcgtcatgggggtaatgctctggacgcccgcgctcatccccaagggatgcttcctcaacctcgaggaaggccacgacgtggtccggtgccgcaccgacgaggcgctcgaccgcgccaagtcgctcgtgaacctgcagttcagctggtacctcaccggcaccgtggtgttcgtcgtcctgttctacctccacatggctaagctctacccggaggagccgcagtacttgccgctggtaaagggcggcggcggcgacagcgacagccggttcagcatcggagatgaccacgacgacgaggacgacctcgaggcctccaagcgtggcttcgggcacgtggtgagcggcgcaaagcctgtcgaaatcgagaggtgaaatcgtagcaccgtaaggttgggaaacgttctttctgtgattacagtgtgatttggcttcagcgtttgtggtgagaaatgtacaatttgtacgtactccctcc

SEQ ID NO: 221 - DNA, 1741 bp, Zea mays
ctcgaacacgttgcacaaggagagatttttttttacagccggataacacaggttttcttgatcatttgtcaactcaaatcgtttgcgattacagtggattgccgttgttgcgggcttaattataaagagaactgcaggcataaagccagtccatgcaggcatacagcctagcgatcgcagcagtcaatggtcaacgcctgacactattgaattagcgtggtgacaagtaggataagatggcttcaggtaggataaatataggattcttttaatccacaagtgtcactgtgtcacaaactataaacattacaacctccctagagaatatttgcatgttttaatttcaccaataaacaaaaacgttcaagtcaaattacactataaccacgcaacaacatgctaaccttttgtacggtgctacgcacgaccctcacctctcgatttcgacaggcctcgtgccgctaaccacgtgtccgaaaccgccacgttttgcggcctcgacgtcgtcctcatcgtcgtgatcatcatctccgatgctgaaccggccatcgctgccgctgccgcctcccttcaccagcggcaggtactgcggctcctcggggtagagcttcgccatctggaggtagaacaggacgacgaacaccaccgtgccggtgaggtaccagctgaactggaggttgacgagcgacttggcgcggtcgagcgcgtcgtcagtgcggcaccggacgacgtcgtgcccttcctcgaagttgaggaagcagcccttgggtatgagcgccggcgtccacagcatgacgcccatgacgacgaaccagacgccctggaacacgaggctggcggaccggaccaggctcaccgcgaagctccgcgggtaggggatacccagcagcgtggtcgcgagcgtgacggcgatggccgtctgcagcagccagtggaactgcccctccacgcccatgtggtccgccgagtggaggtggaagatgagcagctgctgcgcgaacgccgcggcggccacgagctgcgacacggcgtcccgcatgggcgccctcgccctgtccaggtggatggtcaccgccgcgaagacgagcagcgccagcgagatggacgcgtgctcgaagttgtggaggtggtcggacgggatggtgccgtcgtcgtcgaacggctggtgcttcgcggggccgatgacgagctccatcaggatggacagcaccgtgccgatgattatgagtatgagctccaggtgccgcacgcccggcaccgggaaccagaccggggcagagtacgagctcggccgcagcaggaacaggcgggtgtggctgaacagctgccacaggccgatgaggaggaagccggcgcccggcgcgacgtgcccgacgagggtgcccatggcgtgtgccgccgcgctgtgccttttgcgtgcgactgcggaagtggacgacaggggaagaagttggtggtggcgtgtggagaggggaggtttgaaggttgatgggcgaatattgtgggggtttaagaaggtctgcagggtgtctggagtgttcggaaggtttgaagagcacattcggatttgaaacgtcttttgcatgtgtgttcatcagcagtgatgttgtagcgttgaaagctggtcgccaggtgatttgttcttagttttgtttcgcttgcttgtcatggcttccgattgaatatgtagctccaagtttcttatcttttccattgatatgctaaatattttttatttaag

SEQ ID NO: 222 - DNA, 1936 bp, Zea mays
taataaccggagcagtagttagtgatatccaaaagagtgttatccgcgacaatcttaaataaaaaatatttagcatatcaatggaaaagataagaaacttggagctacatattcaatcggaagccatgacaagcaagcgaaacaaaactaagaacaaatcacctggcgaccagctttcaacgctacaacatcactgctgatgaacacacatgcaaaagacgtttcaaatccgaatgtgctcttcaaaccttccgaacactccagacaccctgcagaccttcttaaacccccacaatattcgcccatcaaccttcaaacctcccctctccacacgccaccaccaacttcttcccctgtcgtccacttccgcagtcgcacgcaaaaggcacagcgcggcggcacacgccatgggcaccctcgtcgggcacgtcgcgccgggcgccggcttcctcctcatcggcctgtggcagctgttcagccacacccgcctgttcctgctgcggccgagctcgtactctgccccggtctggttcccggtgccgggcgtgcggcacctggagctcatactcataatcatcggcacggtgctgtccatcctgatggagcttgtcatcggccccgcgaagcaccagccgttcgacgacgacggcaccatcccgtccgaccacctccacaacttcgagcacgcgtccatctcgctggcgctgctcgtcttcgcggcggtgaccatccacctggacagggcgagggcgcccatgcgggacgccgtgtcgcagctcgtggccgccgcggcgttcgcgcagcagctgctcatcttccacctccactcggcggaccacatgggcgtggaggggcagttccactggctgctgcagacggccatcgccgtcacgctcgcgaccacgctgctgggtatcccctacccgcggagcttcgcggtgagcctggtccggtccgccagcctcgtgttccagggcgtctggttcgtcgtcatgggcgtcatgctgtggacgccggcgctcatacccaagggctgcttcctcaacttcgaggaagggcacgacgtcgtccggtgccgcactgacgacgcgctcgaccgcgccaagtcgctcgtcaacctccagttcagctggtacctcaccggcacggtggtgttcgtcgtcctgttctacctccagatggcgaagctctaccccgaggagccgcagtacctgccgctggtgaagggaggcggcagcggcagcgatggccggttcagcatcggagatgatgatcacgacgatgaggacgacgtcgaggccgcaaaacgtggcggcttcggacacgtggttagcggcacgaggcctgtcgaaatcgagaggtgagggtcgtgcgtagcaccgtacaaaaggttagcatgttgttgcgtggttaaagtgtaatttgacttgaacgtttttgtttattggtgaaattaaaacatgcaaatattctctagggaggttgtaatgtttatagtttgtgacacagtgacacttgtggattaaaagaatcctatatttatcctacctgaagccatcttatcctacttgtcagttgtcaccacgctaattcaatagtgtcaggcgttgaccattgactgctgcgatcgctaggctgtatgcctgcatggactggctttatgcctgcagttctctttataattaagcccgcaacaagccaacaacggcaatccactgtaatcgcaaacgatttgagttgacaaataatgatcaagaaaacctgtgttatccggctgtaaaaaaaaatctctccttgtgcaacgtgtccgagctaaaaaaacagcagttccacctggcaatcttcccggacaagaaagctgagccacacagatcgagcacaggaatttggcatgtctcgccgcatgatggatggaattcaagcaaaccgatgactg

SEQ ID NO: 223 - DNA, 1367 bp, Brachypodium distachyon
ccaacattttccctcctctccccacagtccaaaaaggatcgggacgccatgggcaccctcgtcgggcacgtcgcgccgggcgctggcttcctcctcatcgggctgtggcagctgttcaaccacatccggctgttcctgctgcggcccggctcctacgtcgcgcccgtctggttcccggtgcgcggcgtccggcacctcgagctcatcctcgtcattgccggctcggccatgtccatcctgatggagctcgtcatcgggccggccaagcaccagccgttcgacgacgacggcaccatcccgtccgaccacctgcacaacttcgagcacgcgtccatctcgctcgcgctgctcctcttcgctgcggtggccatccacatggacagggccaggccgagggcgccgcccatgcgagacgccgtctcgcagctcgtggccggcgcggcattcgcgcaggagctgctcgtcttccacctccactcggcggaccacatgggcgtggagggccagttccactggctgctgcagaccgtcgtcgccgtgaccctgctcaccacgctgctggggatcccttgcccccggagcatcgccgtgagcctgacgcggtcggccagcctcgtgttccagggcgtctggttcgtcgtcacgggcgtcatgctctggacgcccgcgctcgtgcccaagggctgcttcctgaaccgcgaggacgggcacgacgtggtccggtgccgcgacggcgaggcgctcgagcgagccaagtcgctggtgaacctgcagttcagctggtacctgacggcaaccgtgctgttcgtcgtcgtgttctacctctggctcggcaagatgtactccgaggagccgcggtacttgccgctggtgaagggaaaccacgcggagggagacggagacggtggtcggttcagcatcggagacgatcaagacgacgacgaggacgacgtcgagtctgccaagcatagcttcgggcacgtggttagtatcacaaagccgatcgagattgagaggtaaaattacgaggaaatcagatcaggatagttgtgtactgtactgtacaatgtatataggacaactggtgtactgtaaattttattactccgtacaattggcatgttgagtgacctgacccgtaagtgcgggtacagttcgtgtttggtcactttaatttgtttattaccctcattacttaagggtgtcagccaatcaatggtgttactagacacatactagctgatatacacacgtcatccgtcgatttgttcctgttcgcttggcacatttctccaggataaaccctctttgatagcgagtgcagaaatgaaataaaataaaatgttcaagtcttgtattactccgta

SEQ ID NO: 224 - DNA, 2048 bp, Saccharum officinarum
gaacggacgagcgagcaagccccgcaggcccgcagccacagctccgctcccgtccccctccgtgcgctgtgctgccgccgcctcccattccccgcgcggcgctgccgagtgccgtcgtacgtcccgccggccggagttggtctgggttggatctctcggagtcggagcgagcgagcgagatgggcggcggcaacggtgatggaaccaccccgctgggggagccgctgctggcgaagcaggcgagggcgtaccggccgaggtgccccggctgccgcgtcgaccgcctgaacgcggagcgggaaggggtgttccctctcaaggacctcttcctcatctggctcgtcaccatcacctgcaccctgccaatccagtctctgtttcccttcttgtattttatgataagggatctgaatattgctaaacaaacacaagacattggattttatgctggttttgttggcgcttcatatatgtgtgggagagcagtctcctcaacagtatggggaatcgtggctgataagcatggaaggaaaccagttatcgtactgacccttgttgcaatagttatcttcaatactctctttggactaagctcaaactattggatggcgttaatcacacgatgcctgcttggggtcatgtgtggttatctcgggccaattaaggcttatgctacagaagtgtgccgaaaagaatacaatcatctggctttggcagttgtttcttcttcacgaggcattggtctcattattggaccagctattggtggttatcttgcgcagcctgcagataaatatccaagcatattctctcagacatccatatttgggaggtttccatattttcttccctgcctgtgtatatcgatccttgcagttgttgctctaattgcctgcatctggtttccggaaactttgcataaacacaatgaggataccgttgataattcagttgaaactgtagaagaatctcttgctgatacagacactgaagaaaatggaggtggtggatgtctaaaattatttacaaactggccgttgatgtcatctattactttatattgtatcttctctcttcaggatgtggcttatgcagagacgttctctctttgggctgtcagtgacagatcgtatggtggattaagctttactaccacagatgtgggcaatgtccttgcaatgtcaggtctcttcctttttctatatcaaatgttgatttatccattgcttgcaaaaatggtggaccacattacattagttcgtgcagtggcgatattgactctaccacttcttgctagctatccattctttccttcattgaaagggttcatgcttatgttggtagtaaattgtgcatcttttctgaagaatactttctcggtaactaccattaccgtgttcaacattttgatgaatgaagctgtgactcaggatgtaagagctgcagccaatggtatagctgtaacactaatgtccatttctaaagctgttgctccagctgttgcaggaattatattttcatgggcccagaggcgtcaaacagcttcatttcttccaggcgaccacttggtgttcttcatactgaacatcttcacgctcaccggtctcatcttcaccttcagaccgttttttgttcgaggcagcgcgaagcactgaaacatgaacgaagcagacccatggtaataggtatcctatccaggggcaatgaaatatgaattttcttccggcgtggccgagggaggtgccgagcctgtacgacccaggcaagaacacaagcgtatggtacacagcaaggctgtgttgttgtaagttttgtaatttctgtttcttcttctcggcttcgcagcatgcagttgctgtacatgatggaagaacattctgttactgggcatgttgctcagttttcacgcgtgtaagtaatgtagaaatcgtaatgggaggtatttccatactgtcattagtggagcattgatttttttgtaaggaagttattacaatgccttttcccgggcatgaataagaaaagggaaatatgcttatatgcatatt

SEQ ID NO: 225 - DNA, 1816 bp, Sorghum bicolor
tctgggttggattggatctctcggagcgagatgggcggcggcaacggcgatggaaccaccccgctgggggagccgctgctggcgaagaaggggagggcgtaccggccgaggtgccccggatgccgggtggaccgcctgaacgcggagcgggagggggtgttccctctcaaggacctcttcctcatctggctcgtcaccatcacctgcaccttgccgatccagtctctgtttcccttcttgtattttatgataagggatctgcatattgctaaacaaacacaagacattggattttacgctggttttgttggcgcttcatatatgtttgggagagcactctcctcaacaatatggggaatcgtggctgataagtatggaaggaaaccagttatcgtactgacccttgttgcaatagttatcttcaatactctctttggactaagcttaaactattggatggcattaatcacacgatgcctgcttggggtcatgtgtggttatctcgggccaattaaggcttatgctacagaagttgtccgaaaagaatacaaccatctagctttagcagttgtttcttcctcacgaggcattggtctcattattggaccagctattggtggttaccttgcacagcctgcagataaatatccaagcatattctctcagacatccatatttgggaggtttccatattttcttccctgcctgtgtatatcgatccttgcagttattgctctaattgcctgcatctggtttccggaaactttgcataaacacaatgaggataccgttgataattcagttgaaactgtagaagaatctcttgctggtacagacactgaagaaaatggaggtggtggatgtctaacattgtttaaaaactggccgttgatgtcatctattactttatattgtatcttctctcttcaggatgtggcttatgcagagacgttctctctttgggctgtcagtgacagatcatatggtggattaagctttactaccacagatgtgggcaatgtccttgcaatgtcaggtctcttcctttttctgtatcaaatgttgatttatccattgcttgcaaaagcggtggaccacatcacattagttcgtgcagtggcgatattgactctaccacttcttgctagctatccattctttccttcattgaaagggttcgtgcttatgttggtagtaaattgtgcatcttttctgaagaatactttctcggtaactaccattaccgtgttcaacattttgatgaatgaagctgtgactcaggatgtaagagctgcagccaatggcatagctgtaacactaatgtccatctcaaaagctgttgctccagctgttgcaggaattatattttcatgggcccagaggcgtcaaacagcttcgtttcttccaggcgaccacttggtgttcttcatactgaacatcttcacactcaccggtctcatcttcaccttcagaccgttttttgttcgaggcagcgcgaagcactgaaacatgaatgaagcagacccatggtaataggtatcctatccaggggcaatgaaatataaattttcttccggcgtggccgagggaggtgccgagcctgtacgactgaggcaagagcacaagcgtatggtacacagcaaggctgtgttgttgtaagttttgtaatttctgtttattcttctcggcttcgcagcatgcatcagttgctgtatatgatggaacaacgtctgttactgggcatgttgctcggttttcacgcgtgtaagtaatgtagaaatcgttatggtaggtatttccatactgtcattagtgg

SEQ ID NO: 226 - DNA, 2105 bp, Echinochloa colona
tagccccgtagccagacataaaagtaacccaagcgcgggctggctactcgctcgcctactcggctccgctcctctcctctcccgtgcccctgcgcccgctgctcgcgctagcgtcgccgcctccggcctcgtctcattccgcggcgcggcgccgcttccgagcgccgactggagacctccaccggcagcccggcaccggagttggtttgggttggatctagcggggaggtacgaaatgagcggcggcggcggagtgacggcgctgggggagccgctgctgacgaagaaggggagggcgtacaggccgcggtgcccggggtgccgggtggaccgcctcaacgccgagcgggagggggtgttccccttcaaggacctcttcctcatctggctcgtcaccatcacctgcaccctgccgatccagtctttgtttcccttcttgtattttatgataagggatctgcacattgctaaacagacccaagatattggattttatgctggttttgttggcgcttcatatatgtttggaagagcaatctcctcaacagtatggggaattgtggctgataagcatggaaggaaaccagttatcgtattgactcttgtttcaataattatcttcaataccctctttggattgagcttgaactattggatggcattgatcacacgatgtctgctcggggtcatgtgtggctatctcgggccaattaaggcttatgctacagaagtgtgccgaaaagaatacaatcatctggctttagcagttgtttcatcctcacgaggcattggtctgattattggaccagctattggtggttaccttgcacagcctgcagataaatatccaagcatattctctcagacctccatatttgggaggtttccatattttctcccctgcctatgtatatcaatccttgcagctgttgctctagttgcctgcatctggtttccggaaactctgcataaacacaatgaagatacagttgataaatcagttgaagctatagaagaatctcttgctggtacggacactgaagagagtggaggtggtggatgcctacaattatttacaaactggccgttgatgtcagctattactttatattgtattttctctctccaggatgtggcttatgcagaggtattttccctttgggctgtcagtgacagatcgtttggtggattaagctttacttccacagatgtgggcaatgtccttgcagcgtcaggtctcttcctttttctatatcaaatgttggtttatccattgcttgcaaaatcggtagaccacatcacattagtccgaggagtggcgatattgactgtaccacttcttgctagctacccattctttccttcgttgtcagggttcgttcttatgttggtagttaatttcgcatcttttctgaagaacactttctcggtaactaccattaccgtgtttaacattttaatgaatgaagctgtgccacaggacgtaagagcggcagccaatggcatcgctgtaaccctaatgtccatctctaaagctgttgccccagctgttgccggaattatattttcatgggcccaaaggcgccaaacagctgcatttcttccaggcgaccacttggtgttcttcatgctgaacgtgttcacggtcaccggcctcgtgttcaccttcagacccttttttgtccgaggcagcgcgaagcactgaaacatgaattgaacactgggggcaaggagatacatattttcttccggcgcggccgagcctgtacggtacgacccaggcaaagaacacaaagttgtatggcgcgcagcgaagccgtgttgttgtaattcttgtaatttctgcttccttcttctcatccccttcgcagcatgccgttgctgtatagtagtatggtggaagaacattctgttgccgcgcatgttgctcagttttcacgcgtgtaagtaaatgtagaaatcgtccaggaccggtaggtgattgtgtatcgtcgctagagtgaagcattgattttgtaagaaggttacgaattacgatgcccgctttcacgggcatgatgggtgaataagaaaaaggaaaatacgcatgtgaagaataaacgagc

SEQ ID NO: 227 - DNA, 2082 bp, Echinochloa colona
tagccccgtagccagacataaaagtaacccaagcgcgggctggctactcgctcgcctactcggctccgctcctctcctctcccgtgcccctgcgcccgctgctcgcgctagcgtcgccgcctccggcctcgtctcattccgcggcgcggcgccgcttccgagcgccgactggagacctccaccggcagcccggcaccggagttggtttgggttggatctagcggggaggtacgaaatgagcggcggcggcggagtgacggcgctgggggagccgctgctgacgaagaaggggagggcgtacaggccgcggtgccctgggtgccgggtggaccgcctgaacgccgagcgggagggagtgttccctttcaaggacctcttccttatctggctcgtcaccatcacctgcaccctgccaatccagtctttgtttcccttcttgtatttcatgataagggatctgcacattgctaaacagacccaagatattggattttatgctggttttgttggcgcttcatatatgtttggaagagcaatctcctcaacagtatggggaattgtggctgataagcatggaaggaaaccagttatcgtattgactcttgtttcaataattatcttcaataccctctttggattgagcttgaactattggatggcattgatcacacgatgtctgctcggggtcatgtgtggctatctcgggccaattaaggcttatgctacagaagtgtgccgaaaagaatacaatcatctggctttagcagttgtttcatcctcacgaggcattggtctgattattggaccagctattggtggttaccttgcacagcctgcagataaatatccaagcatattctctcagacctccatatttgggaggtttccatattttctcccctgcctatgtatatcaatcctcgcagctgttgctctagttgcctgcatctggtttccggaaactctgcataaacacaatgaagatacagttgataaatcagttgaagctatagaagaatctcttgctggtacggacactgaagagagtggaggtggtggatgcctacaattatttacaaactggccgttgatgtcagctattactttatattgtattttctctctccaggatgtggcttatgcagaggtattttccctttgggctgtcagtgacagatcgtttggtggattaagctttacttccacagatgtgggcaatgtccttgcagcgtcaggtctcttcctttttctatatcaaatgttggtttatccattgcttgcaaaatcggtagaccacatcacattagtccgaggagtggcgatattgactgtaccacttcttgctagctacccattctttccttcgttgtcagggttcgttcttatgttggtagttaatttcgcatcttttctgaagaacactttctcggtaactaccattaccgtgtttaacattttaatgaatgaagctgtgccacaggacgtaagagcggcagccaatggcatcgctgtaaccctaatgtccatctctaaagctgttgccccagctgttgccggaattatattttcatgggcccaaaggcgccaaacagctgcatttcttccaggcgaccacttggtgttcttcatgctgaacgtgttcacggtcaccggcctcgtgttcaccttcagacccttttttgtccgaggcagcgcgaagcactgattgaacactggcggcaaggagatacatattttcttccggcgcggcccagcctgtacggtacgacccaggcaaagaacacaaagttgtatggcgcgcagcgaagccgtgttgttgtaattcttgtaatttctgcttccttcttctcatccccttcgcagcatgccgttgctgtatagtagtatggtggaagaacattctgttgccgcgcatgttgctcagttttcacgcgtgtaagtaaatgtagaaatcgtccaggaccggtaggtgattgtgtatcgtcgctagagtgaagcattgattttgtaagaaggttacgaattacgggcatgatgaataagaaaaaggaaaatacgcatgtgaaggaataaacgagcaag

SEQ ID NO: 228 - DNA, 1821 bp, Echinochloa colona
aaagccccgtagccagacagacagaacccaagcgcgggctactcctctctcgcctacttggctccgctcctctcccgtgcgcgcccctgcgctcgctgcttgcgctagcgtcgccgcctccggcctcgtctcattccgcggcgcggcgccgctgccgagtgccgaccggagacctccaccggcaccggagttagtttgggttggatctagcggggacgtactgtacgagatgggcgacggcggcggcggcggaggaggagtgacggcgctgggggagccgctgctgacgaagaaggggagggcgtacaggccgcggtgcccggggtgccgggtggaccgcctcaacgccgagcgggagggggtgttccccttcaaggacctcttcctcatctggctcgtcaccatcacctgcaccctgccgatccagtctttgtttcccttcttgtattttatgataagggatctgcacattgctaaacagacccaagatattggattttatgctggttttgttggcgcttcatatatgtttggaagagcaatctcctcaacagtatggggaattgtggctgataagcatggaaggaaaccagttatcgtattgactctcgtttcaataattatcttcaataccctctttggattaagcttgaactattggatggcattgatcacacgatgtctgctcggggtcatgtgtggctatctcgggccaattaaggcttatgctacagaagtgtgccgaaaagaatacaatcatctggctttagcagttgtttcatcctcacgaggcattggtctgattattggaccagctattggtggttaccttgcacagcctgcagataaatatccaagcatattctctcagacctccatatttgggaggtttccatattttctcccctgcctatgtatatcaatcctcgcagctgttgctctagttgcctgcatctggtttccggaaactctgcataaacacaatgaagatacagttgataaatcagttgaagctatagaagaatctctttctggtacagacactgaagaaagtggaggtggtggatgcctacaattatttacaaactggccgttgatgtcagctattactttatattgtattttctctctccaggatgtggcttatgcagaggtattttccctttgggctgtcagtgacagatcgtttggtggattaagctttacttccacagatgtgggcaatgtccttgcagcgtcaggtctcttcctttttctatatcaaatgttggtttatccattgcttgcaaaatcggtagaccacatcacattagtccgaggagtggcgatattgactgtaccacttcttgctagctacccattctttccttcgttgtcagggttcgttcttatgttggtagttaatttcgcatcttttctgaagaacactttctcggtaactaccattaccgtgtttaacattttaatgaatgaagctgtgccacaggacgtaagagcggcagccaatggcatcgctgtaaccctaatgtccatctctaaagctgttgccccagctgttgccggaattatattttcatgggcccaaaggcgccaaacagctgcatttcttccaggcgaccacttggtgttcttcatgctgaacgtgttcacggtcaccggcctcgtgttcaccttcagacccttttttgtccgaggcggcgcgaagcactgaaacatgaattgaacactggcgacaaggagatacatattttcttccggcgcggccgagcctgtacggtacgacccaggtaaagaacacaaagttgtatggcgcgcagcgaa

SEQ ID NO: 229 - DNA, 1488 bp, Echinochloa colona
gcccctgcgcccgctgctcgcgctagcgtcgccgcctccggcctcgtctcattccgcggcgcggcgccgctgccgagtgccgaccggagacctccaccggcaccggagttagtttgggttggatctagcggggacgtactgtacgagatgggcgacggcggcggcggcggaggaggagtgacggcgctgggggagccgctgctgacgaagaaggggagggcgtacaggccgcggtgcccggggtgccgggtggaccgcctcaacgccgagcgggagggggtgttccccttcaaggacctcttcctcatctggctcgtcaccatcacctgcaccctgccgatccagtctttgtttcccttcttgtattttatgataagggatctgcacattgctaaacagacccaagatattggattttatgctggttttgttggtgcttcgtacatgtttggaagagcaatctcctcaacagtatggggaattgtggctgataagcatggaaggaaaccagttatcgtattgactcttgtttcaataattatcttcaataccctctttggattgagcttgaactattggatggcattgatcacacgatgtctgctcggggtcatgtgtggctatctcgggccaattaaggcttatgctacagaagtgtgccgaaaagaatacaatcatctggctttagcagttgtttcatcctcacgaggcattggtctgattattggaccagctattggtggttaccttgcacagcctgcagataaatatccaagcatattctctcagacctccatatttgggaggtttccatattttctcccctgcctatgtatatcaatccttgcagctgttgctctagttgcctgcatctggtttccggaaactctgcataaacacaatgaagatacagttgataaatcagttgaagctatagaagaatctcttgctggtacagacactgaagaaagtggaggtggtggatgcctacaattatttacaaactggccgttgatgtcagctattactttatattgtattttctctctccaggatgtggcttatgcagaggtattttccctttgggctgtcagtgacagatcgtttggtggattaagctttacttccacagatgtgggcaatgtccttgcagcgtcaggtctcttcctttttctatatcaaatgttggtttatccattgcttgcaaaatcggtagaccacatcacattagtccgaggagtggcgatattgactgtaccacttcttgctagctacccattctttccttcattgtcggggttcgttcttatgttggtagttaatttcgcatcttttctgaagaacactttctcggtaactaccattaccgtgtttaacattttaatgaatgaagctgtgccacaggacgtaagagcggcagccaatggcatcgctgtaaccctaatgtccatctctaaagctgttgccccagctgttgctggaattata

SEQ ID NO: 230 - DNA, 1117 bp, Zea mays
cataaaaggtgtataaaattgacgactaattattaatcaagacataaaaggtgtataaaattgacggggcgatgacccactttgccccctatagatccgccttctgtctgtcatatctgtgtgatgctgaatatgcacattgtgaaccaaacttataagatactgtattttgagcataaacttcatctaaaaggacagggaatgcaacgccggtatgcgatgaaccctccctcctgtctacttggaatttggaatcgtggactcaaagctctcagatttcacgccagtacattgtacaggatcagaagtcagtcgatcgtacacagtccaaaacgcccgaacggaagtggcagaacttttcatcatcatcatcatccgatcatcgtcgtatatttacaataatcagctcgcgagctcgcggtcgctgaagaaggccaaagaccagctaagatacgaaaggctagttaattgggtccccagcagctgaggtacatgacggtcctcaagccctcctccgcggcggccttgtcctgccgccccttctccgccgccggggccaggtccttgtcccgctgcgcggcgaagcttctgctgccgctgcgcacgttggccttggcggtccggtagacggaccgcagcgcgtagttccagcggcagaggcctccctggtccttgagcgcttccacggcgcccacgctcatggccaccatccacgacgacgccttcgtcgctgctgctgctgccatctcctcccggtgttggtcttctcctcctctctcgagagaaaactttcgcttgttgtttcttgtttgtagcgagtgaggttgcttggttggtggtgctgtgttgaggtggagaggcgagccggagcgggtgggttatatgtaccggcgggcggggacggggacggggacggggacgggaacggggcggcggaaattggtgggcgcggacccctggttttcctggataccgggggctctcctcaccgtctgcggctcgctttcttgcgcgccggcacagtccagtggcactcgtcgtcttgtttaatcgggcctccgcgtcgacagggacgcgcaaccgcaaatagcacgggacgccacgctctcatcccttt

SEQ ID NO: 231 - DNA, 714 bp, Zea mays
acctcaacacagcaccaccaaccaagcaacctcactcgctacaaacaagaaacaacaagcgaaagttttctctcgagagaggaggagaagaccaacaccgggaggagatggcagcagcagcagcgacgaaggcgtcgtcgtggatggtggccatgagcgtgggcgccgtggaagcgctcaaggaccagggaggcctctgccgctggaactacgcgctgcggtccgtctaccggaccgccaaggccaacgtgcgcagcggcagcagaagcttcgccgcgcagcgggacaaggacctggccccggcggcggagaaggggcggcaggacaaggccgccgcggaggagggcttgaggaccgtcatgtacctcagctgctggggacccaattaactagcctttcgtatcttagctggtctttggccttcttcagcgaccgcgagctcgcgagctgattattgtaaatatacgacgatgatcggatgatgatgatgatgaaaagttctgccacttccgttcgggcgttttggactgtgtacgatcgactgacttctgatcctgtacaatgtactggcgtgaaatctgagagctttgagtccacgattccaaattccaagtagacaggagggagggttcatcgcataccggcgttgcattccctgtccttttagatgaagtttatgctcaaaatacagtatcttataagtttggttcacaa

SEQ ID NO: 232 - DNA, 2234 bp, Sorghum bicolor
attaaccccccgcgtgcgttccctccctctgtcagtctgtctctctcttggcgtcgactgggcgaccgtcgcagccgccctaagccaggtacccaggccatcttcgggcccttcgccggcgacgagcaccaccaggaattttcccagctgtagcaatgatgggttgcttcactgttctcagatccaagaagaagaaaatcccttttgataatcctcttcttccaagcaagaaatcggttgatgcaagggaaagtacgtcgtctagacttccggaaccagaagttcatgtgccatctttgcaatcagctcctcctagttttaggaacaggactaagatatcccagtcgtcaaataaagtttcaaacagcagagctcgcgtgttgtctgctccgtcaacccttattgtggttgatcagtttggctttccatatgctgaataccgagatcaagacgactccagagataaggaaggttcaacaaaggggcatcgcttttcaaatcctttgccccttcctcttccttcaccggaaggacattcttttaggaactctggtagcttcaaagctagcaacgtaagtgggccattggagatgtccggccctctcccattgcctccaaagaaatgtgatggacttagaatcttttcttacgaggaggttttgtctgcttgccaatggttttcaagtgatcagtgtgtttcagaagcacttggttcaacatcatacaaggcaacatttagggatgaatttattgatacaaagaccactgaagcaacggtagctcgattactcccctccactcagagtttgaaggagtttaaaacacaagcaactacactggcattgcttcagcatcccaatttatgtaaactgattggctattatgcaaaagaagattctaatgaaaggatgttggtctatgaacggcttcatcatgggagcttagataagctactctttggaagaccagatggtcgtttcatggactggtctaaacgtttgaaggttgcccttggtgcggccagaggtcttgctttcttgcatgatgaaggaccctttcaggccatgtacagcgagttctcaactttgaacatccaaatagataaagatttcactgctaagctttcaggatatggttgtgttggcttcaatactgaggagatatctaatgcacctgcgtctgcagcaaacctttcggtggagaccttggagaagggtttactcactcccaagagcaatgtctggagctttggagttgtgttactggagctaataactggaaggaagaaccttgatgccaattcttctaaagaagaacgcaatattgtcaggtggagtaggcctttccttactgatgatagtcgcctatctctgatcatggactcccgtataaaagggcgctttcctactaaggctgctcggatagtagcagacatcattctgcaatgcttgcataatgatccatccgagaggccgaccatgagggatgttgtggaggctctagcaagagtccaggagataaaggttccgtgcagatatcctttgcaagaaccttctgctgcaccaagaaaagtaatgctaaaatctacatccctcaatggaattgtgcctcatcatcctgtcataaccttctctccatcgccgccttcgcataaccagcacttgatttcaccaaggtcatcaacatctgccttgtttcatccaaggacatgctcttctactctggatgatcccggtgtaagctctataaagaaaacacctcctattatgcgtaggtctagcgttgaaggcttttgattgtccatattgttcttttatttctttttctcggatttatttgtttctttgttagcctagtgattttagctgtgttctgtattgtaagacaagtggccttatgtagtgcccttgagtctcgagtaataactaagcagagcaggatgaattgtaaatagtatcaggttgtagatacctttttgtgctctaattgggtggaagcagcgtgctgagtctgagtaggccttgtaacctcataaataaactcgtttcccagtttctgttcacccttcccgtacgtcaaatgtctctgctgtttccttcggtgccatgtgttgggtgcctagtgttgttgcttgtcggcaagcttttgtgttatcgaatgtctctatccacatgataatctcatgtggcatgttgcagccggtacaaggaaactgttgatgatatctgttgcat

SEQ ID NO: 233 - DNA, 2300 bp, Setaria italica
ttgaccagtgccgcttcttggtgctactcctcgccctctctctccaacctccatttacttttctcgccctcatttccccctatatctcgctccctaccatttgctttcctctccggctcccccttcccattcccgtcctccgctcctagatgccaatccctacctgagcagcgagcgaatctcaccccgtcccattcgcaggtgccaccgtgcaagaggtgttccagttccgctgccgagaaattttccctgtcgtacagatgatgggttgcttcactgctctcagatccaagaagaagaaaggccctctagataatcctcttgttccaagcaagaaatctattgatgcaagggaaagtacgtcctctagacttccggagcccgaagttcatgtgccatccttgcaatcagctcctcctagttttagaaacagggctaagatctcccagtcagcaaataaagtttctaacagcagagctcgcgtgttgtctgctccatcaacccttattgtggttgatcagtttggctttccatacgctgaatacaaagatcaagatgactccagggataaggaaggttcaacaaaggggcaccgcttttcaaatcctttgccccttcctcttccttcaccggaaggacattctttgaggaatttcggtagcttcaaagccagcaacgtaagtgggccactggagatatctggccctctcccactacctctagagaaatatattggacttagaatcttctcttatgaggaggtttcatctgcttgccagtggttttctagcgatcagtgtgtttcagaaacacttggttcaacatcatataaggcaaccttcagggatgactttagtggtacgaagaccactgaagcaacggtagctcgattactaccctccactcagagtttgaaggagtttaaaacacaagtgaacacattagcatcgcttgagcatcccaatttatgtaagctaatcggctattatgcaaaagaagattctaatggaaggatgttggtctatgagcggcttcatcatggcagcttagataagctattatttggaagacctgatggtcgtttcatggactggtctaaacgtttgaaggttgcccttggtgctgctagaggtctagctttcttacatgatgaaggaccatttcaggccatgtacagtgagttttcaacttcaaacatccaaatagataaagatttcactgctaagctttcaggatatggttgtgctggcttcaacacagaggagatatctaatgcacctgtgtctgcagcacacctttcggtggagaccttggcgaaaggtttactcactcccaagagcaatgtgtggagctttggagttgtgttactggagctaataactggaagaaagaatcttgatgtcagttcctccaaagaagaacgcaatatcgtcaagtggagtaggcctttccttactgatgatagtcgcctatccctgatcatggactcacgaataaaagggcgctttcctaccaaggctgctcggatagtagcagacatcattctgaaatgcttgcataatgatccttcagagaggccaacgatgagggatgttgtggaggccctaacaggggtccaggaaataaaggttccgtgccgatatcctctgcaagagccatctgctgcaccaagaaaaaggatgttaaaatctacatccctcaatggaattgtgccccagcatcctgttataaccttctctccatcgccaccttcacataaccaacccttgatctcgccaaggtcatccacatctgctttgcttcatccaaggacatgctattctactctggatgatcccagggtaagctctatcaggaaaacacctccccccatcatgcgtaggtctagcgtggaaggcttttgattgtccatattgttcttttatttccttttcttcgatttatttgtttctttgttagcctagtgatttttagtgctatgtgctgtattgtaagaccaagtggccttatgtaatgcccttgagtaataactaagtagagcagggtgaattgtaaataggaccaggttgtagatacctttttgtgctctaattggttggaagcagcgtgctgagtgggccttgtaacctcattatgcaataaactcgtgctacccggtttctgttcgccggtacgccaaaaatttcagcagtttttctttgggcgccaagtgttgggtgcctagtgtcgtcgcttgtcggcaagcacttgtgtaatcgagtgcctccatccacatgacgatctcatgtggcatgttgctg

SEQ ID NO: 234 - DNA, 2347 bp, Panicum virgatum
cctctctctctctctctctatttacttttctcgcccttcgtttgcccctatatctcacgccctaccatttgctttcctctccggctcccctccccattcccgtcctccgcccccctagattccaatccctacctgagcagcgagcgaatctcgccccgtcccattcgcaggtgccgccgccgccgtgccggaggagtcccagttgcgctgccgagaaattttccctggtgtacggatgatgggctgcttcactgttctcagatccaagaagaagaaatgccctcttgataatccttttgttccgagcaagaaatcgattgatgcaagggaaagtacgtcctctagacttccggagccagaagttcatgtaccatccttgcaatcagctcctcctagttttagggacagggctaaaatctctcagtcggcaaataaggtttataacagcagagctcgtgtcttgtctgctccatcaacccttatcgtggttgatcagtttggctttccatacactgaatatagagatcaagatgactccagggataaggaaggttccacaaagggtcaccgcttttcaaatcctttgccccttcctcttccttcaccggaaggacattctttgaggaactttggtagcttcaaagccaacaacgtaagtgggccactggagatgtctggccctctcccactgcctccaaagaaatgtgatggacttagaatcttctcttatgatgaagtttcatctgcttgccagtggttttctagtgatcagtgtgtttcagaaacacttggttcaacatcatataaggcaaccttcagggatgactttagtgatacaaagaccactgaagcaacagtagctcgattactaccctccactcagagtttgaaggagtttaaagcacaagtgaacacattagcatcgcttcagcatcccaatttatgtaaattaattggctattatgcaagagaagattccaatggaaggatgttggtctatgagcggcttcatcatggcagcttagataagctactctttggaagaccggatggtcgtttcatggactggtctaaacgtttgaaggttgctctgggtgctgccagaggtctagctttcttacatgacgaaggaccctttcaggccatgtacagtgagttctcaacttcgaacatccaaatagataaagatttcactgctaagctttcaggctatggttgtgttggcttcagtactgaggaggagatatctaatgcacctgcgtctgcagcaaacctttcagtggagaccttggagaaaggtttactcactcccaagagtaatgtgtggagcttcggagttgtattactggagctaataacaggaagaaagaaccttgatgccagttcggccaaagaagaacgcaatattgtcaagtggagtaggcctttccttaccgatgacagtcgcctatccctgatcatggactcccgtataaaagggcgctttcctactaaggctgctcggatagtagcagacataattctgaaatgtttgcataaagatccatcagagaggccaacgatgagggatgttgtggaggctctagcaggagtccaggaaataaaagttccatgccgatatcctctgcaagagccgtctgccgcaccaagaaaaataatgttgaaatctacatccctcaatggaattgtgcctcagcatcctattataaccttctctccatcgccaccttcacataaccaacacttgatctcaccaaggtcatcgacatctgctttgcttcatccaaggatgtgctcccctactctggatgatcccagggtaaggtctacgaagaaaacgcctccccctatcatgcggaggtctagcgtagaaggcttttgaatgtccatattgttcttttatttccttttctttgatttatttgtttctttgttagcctagtgatttttagtgctatgtgctgtactgtaagacaagtggccttatgtaatgcccttgagtaataactaagcagagcaaggtgaattgtaaataggaccaggttgtagatacctttttgtgctctaattggatggaagcgagcgtgctgagtgggccttgttacctcattatgcaatataaactcgtgttacccggtttctgttcgcccgtacgccaaaccttcagctgtttcctttgggcgccaagtgttacgtgccttgtgccagttgcttgtcggcaagcactttgtgttaccgagtgtcgctatccacatgacgatctcatgtgacatgttgcagctggtacaaggaaactgttcgtgacatctgtttgggtagttggagatgctgaattcctgtctgtgga

SEQ ID NO: 235 - DNA, 2202 bp, Panicum virgatum
ggctccctcccccattcccgtcccccgccccctagatgccaatccctacctgagcagcgagcgaatctctcaccccgtcccattcgcaggtgccgccgtcgccgtgccggaggagtcccaccagttgcgctgccgagaaaatttccctgttgtacggatgatgggttgcttcactgttctcagatccaagaaaaagaaatgccctcttgataatccttttgttccaagcaagaaatcgattgatgcaagggaaagtacatcctctagacttccggagccagaagctcatgtgccatccttgcaatcagctcctcctagttttagggacagggctaaaatctcccagtcggcaaataaggtttataacagcagagctcgtgtgttgtctgctccatcaacccttatcgtggttgatcagtttggctttccatacgctgaatatagagatcaagatgactccagggataaggaaggttcgacaaaggggcaccgtttttcaaatcctttgccccttcctcttccttcaccggaaggacattctttgaggaactttggtagcttcaaagccagcaacgtaagtgggccactggagatgtctggccctctcccactgcctccaaagaaatgtgatggacttagaatcttctcttatgaggaagtttcatctgcttgccagtggttttctagtgatcagtgtgtttcagaaacacttggttcaacatcatataaggcaaccttcagggatgactttagtgatacaaagaccactgaagcaacagtagctcgattactaccctccactcagagtttaaaggagtttaaagcacaagtgaacacactagcatcgcttcagcatcccaatttatgtaaattaatcggctattatgcaagagaacattccaatggaaggatgttggtctatgagcggcttcatcatggcagcttagataagctactctttggaagaccggatggtcgtttcatggactggtctaaacgtctgaaggttgctctgggtgctgccagaggtctagctttcttacatgatgaaggaccctttcaggccatgtacagtgagttctcaactttgaacatccaaatagataaagatttcaccgctaagctttcaggatatggttgtgttggcttcagtactgaggaggagatatctaatgtacctgcgtgtgcagcaaacctttcagtggagaccttggagaaaggtttactcactcccaagagtaatgtgtggagcttcggagttgtgttactagagctaataaccggaagaaagaaccttgatgcaagttcctccaaagaagaacacaatcttgtcaagtggagtaggcctttccttaccgatgacagtcgcctatccctgatcatggactcccgtataaaaggccgctttcctactaaggctgctcggatagtagcagacataattctgaaatgcttgaataaagatccatcagggaggccaacgatgagggatgttgtggaggtcctagcaggagtccaggaaataaaggttccgtgccgatatcctctgcaagagccatctgccgcaccaagaaaaataatgttaaaatctacatccctcaatggaattgtgccccagcatcctactataactttctctccgtcgccaccttcacataaccaacacttgatctcaccaaggtcatcgacatctgctttgcttcatccaaggatgtgctcccctactctggatgaccccagggtaagctctatgaagaaaacgcctccccctatcatgcgtaggtctagcgtagaaggcttttgaatgtccatattgttcttttatttccttttcttcgatttatttgtttctttgttagcctagtgatttttagtgctatgtgatgtactgtaagacaagtggccttatgtaaataggaccaggttgtagatacccttttgtgctctaattggaaggaagcgagcgtgctgagtgggccttgctacctcattacgcaataaactcgtgttacccggtttctgttggcccgcacgccagacctttcagctgatttctatgggagcaagtgttaggtaccccttgtatcagttgcttgtcggcaagcgctttgtgttatcgagtgtcgctatccacatgacgatctcatgtgacatgttgcagctggtacaaggaactgttcatgacatctgtttcagtagtta

SEQ ID NO: 236 - DNA, 2153 bp, Oryza sativa
cctcctcctccgtttattttacttttctcccctcttcgcctctcctcgctgctgttatatccgctttcctctcctcctcctcctatcccccctctcctcctgctcctcggcctcctcccctagatgccagccgcggcctgaccctcaccgctggggagcccccctcccattcttcgcttcccccgcggttgcgctcccggagcggcgttccagcggccacagcagctttccctcattgtacacatgatgggttgcttcactgtcctgagatccaagaagaagaagcctcttgctctcaccaagaaatcggttgatgcaagggaaagcacgtcctcaagactcccagagccagaagcgcatgtgccatcgttacaatctgctcctcctagttttaggaacaaggctaaaatccaccaatcggaaaagaaagcttcttacagcagagcgcgcgtgctgtctgctccttccagcctaattgtggttgatcaggatggtcttccatatgccgaattcgatgatcaagatgactccaggggcaagggaggttctataaagggccaccgtttctctaatccactgccccttcctctcccatcaccagaaggaaaatcattgaggaactttggcagcttcaaagccatcaatgcaagtggaccactcgatgcttcaggccctctgccacttcctccaaagaagtgtgatgggcttaagaatttctcctatgaggaactttcatcagcttgccaatggttttctggtgaccagtgtgtttccgaaagtttgacatcaacatcatacaaggcgtcctttagggatgattttaccgacccaaagaccattgaagcaatagtatctcggttgctctcctccactcagagtttgaaagagtttaaaacacaagtgaataccttggcatcacttcagcatcccaacttatgtaaactaatcggctttcacgcaagagaagaatctaatgaaaggatgttggtctatgagcgactccatcatggcagcttagataaactactctttggaagatcggatggtcgtttcatggactggtcagcacgtttgaaggttgctcttggtgctgctagaggcctggctttcctacatgatgaagggccttttcaggccatgtacaatgacttctcaacctcaaacatccaaattgacaaagatttcactgcaaagctatcaggatatggatgtgttggattcaataccgaggaggaaatatcaaatgcatctgtggctgctgcaaacctctcagtggaaaccttggagaaaggtgtactgactcccaagagcaacgtatggtgctttggagttgtcctgctggagctaataacaggaaggaagaaccttgatgtccgttcctcaaaagaagaacgcaatattgtcaagtggagtaggcctttcctcaccgatgatagtcgcctatcgttaatcatggactcccgtataaaaggacgcttccctaccaaggctgctcggattgtagcagatatcatattgagatgccttaataaagatccatcagagaggcctaccatgagggccgttgtggagtccctagcaagcgtccaggacataaaggttccatgtcgatatcctttgcaagagccatctgctgccccaagaaaggtgatgttaaaatctacaagtctcaatggcatcattcatcaccatcctgtcgtaaccttctcaccgtcacctccttcgcgaaaccaacatttgctctcgccaaggtcatccacgtctgcactgcttcctccaaggaccagctgtgctctggatgaccctagagtaagctctatcaagaaatcgccttcccctattttacggagatctggtgttgagggtttttgattgtccatatttttttttctcttctcttcacttcgatttgtttgttgtttttgctagcctagtggttttagtgtaatctcatatattgcaagacaaatggccttatgaactcccttcagtagtactaagaagggaagggtgaactgtagatagaaccaggttgtagatacttttcgttttctaattggatggaagcagcgtgttgagtgcgccttgtaaactccattatgcaataataaacgtgtgtcactcagttcttttttggggagtcaaacatttca

SEQ ID NO: 237 - DNA, 1818 bp, Setaria italica
gttgccagtgaccatccggccatgccagccacactctagcatcttgctataaacagaggcatcaatgaagctcctggaccatcagaacgtagtttatcctctgagcttttcttcttggccctgtctgctgcctcttctcgttctactcccaccaagcaggcaacatgcgcccacagccggcgcaagcgcaagccatggaggccgtcgaggacatcgtcatcgccggcgccgggctcgccggcctcgcgacggcactcggactacacaggaaaggggtgaggagcctggtgctagagtcgtcgccgatgctgcgcgcgtcggggttcgcgttcacgacatggacgaacgccttccgcgcactcgatagcctcggcgttggggacaagatccgggagcaccatttgctttacgagaggatgattaccttctctgctgccactggcgaacctgctgcgaaagtaagcctcaagatgcaggcgaaaagcgggccacacgaaatccggtgcgtgaagcgggacttcctgctgcagacgctcgagaacgagctgcccaagggcaccatccggtactcgtccaagatcgtcgccatcgaggaagacggcaacgccacggtcctgcacttggctgacggttccatcataaagaccaaggttctgatcgggtgcgacggcgtgaactccgtggtggcgaaatggttgggccttccgaagccgatcctctcggggcgctccgccaccaggggcctcgccgagtacccggccggccactgcttcggccccgagatcctgcagttcatcggccagggcttccgctccggcgtcctgccctgctccgacacctccgtctactggaactacacctggtacccttcccccgccgacggggacgccgaggagagcgtggccaagatgcggagccacgtgctgggcaagctgcgggcggccaagatcccggcagcggcgctggacgcgatcgagcggagcgagatgagcgacgtggtgtcgtcgccgctgcggttccggtcgccgctcgcgctcctccgcggcagcatcagccggggcggcgtgtgcgtggcgggggacgcgctccacccgatgacgcccgagctcgggcagggcgggtgcgccgcgctcgaggacggcgtcgtcctggcccggtgcctgggcgaggccttcgcggcggccgggagcggcggcggcggccacgatggggtcatcagggcggcacttgaaaagtacgcggaggccaggcggtggcggagcatccagctcatcacggcggcctacgtcgtcggcttcatccagcagagcaacaacgtcgtcgtcaagttcctcagggacaccttcctgtcgccgttgctggccaagactctagtcgccatggctgactacgactgtggaacgctataattctgctgctcctagctaaacaagggaaccgccgccatttttttcccctcaaaggacgacaaaagctttgccacaagtttcgctacaagaagaaagcaaacaaataaaatgttggacgcagccattagagtaccaagcaagcactgaatttttatgtgatatcaaccaaatcatgagcagattattatgtgaatatctaaaccatgtccgggcattttatttgcccccacacctgaattttgccatctcttttcttcctacttagcaaggatggaggaaaggaaacaaagtttgagtgttaaatggccattaacatcaaaatttctagttagtcattttataccgaacacattagagtcatggtgatttttttatgtgtaatgtctatgctgatttggtgtaactataa

SEQ ID NO: 238 - DNA, 1529 bp, Panicum virgatum
ccgatgaaaccaggggcagaaaatgtctgatacctctggaaagattatctgctgctgctttctgcatgtgcactttgaccagcttcggagcttggtcgcctcgctggaccaaattccaacttctcctcgctggacaagcgtcatgcgaagttgcgagcgaccatccggccatgccagccaccccctagcatcttgctataaaccaaggcatcagagtagctcctggcccatcagaacgtagctatcctgtgaatcctctgagctgttcttcgtgccccctgtctgttgcctcttcgtttctactccaaggcaacaagcgcaagagcaaccgatggcggccgtcgaggacatcgtcatcgccggcgccgggctcgccggcctcgcgacggcactcgggttacacaggaaaggggtgaggagcctggtgctggagtcgtcgccgacgctgcgcgcgtcggggttcgccttcacgacatggacgaacgccttccgcgccctcgatgccctcggcgttggggacaagatccgggagcaccatttgctttacgagaggatggttaccttctcagctgcgactggtgaggctgctgcaaaagtaagcctaaagatgcaggggaaaagcggaccgcacgaaatccgttgcgtgaagcgggacttcttgctgcagacgctcgagaacgagctgcccaagggcaccatcaggtactcgtccaagatcgtctccatcgaggaagacggcaacgtcactgtcctgcacctggctgacggttccaccatgaaaaccaaggttctgattgggtgcgacggcgtgaactccgtggtggcgaaatggctggggcttcccaagccgatcctctcggggcgctccgccaccaggggcctcgccgagtaccccgccggccacggcctcggccccgagatcctgcagttcatcggccagggcttccgctccggcgtgctgccctgctccgacacctccgtctactggaactacacctggtacccttcccccgccgacggggacgccgaggagagcgtggccaagatgcggagcttcgtgctggccaagctgcgcgccgccaagatccccgccacggtgctgggcgtgatcgagcggagcgagatgagcgaggtggtgtcgtcgccgctgcggttccggtcgccgctcgcgctcgtccggggcagcatcagccgcggcggcatctgtgtcgcgggcgacgcactgcacccgatgacgcccgagctcgggcagggcgggtgcgcggcgctcgaggacggcgtcgtcctcgcccggtgtctgggcgacgccttcgccgccggggacggcggccacaaggcggtcgcggcggcgctggggaggtacgccgaggcgaggcggtggcgcagcgtccagctgatcactgccgcctacgtcgtcggcttcatccagcagagcaacaatgtggtggtcaagttcctcagggacaccttcctgtcgccgttgctggccaagacgctagtcgccatggctgactatgactgtgggaccc

SEQ ID NO: 239 - DNA, 1650 bp, Oryza sativa
gcagcagtacagccttcgaccatcctcactctgtttccacttgcgagcgacaccaaccgcgggtgggggttcgcgaacaatggagggctcgggcgtcgagggcatcgtcatcgccggcgccggcctcgcggggctcgcgacggcgctcgggttacacaggaaaggggtgaggagcctggtgctggagtcgtcggcgacgctgcgggcgtccgggttcgcgttcacgacatggacgaacgccttccgcgcgctcgacgcccttggtgtcggcgacaagatcagggagcatcatctgctctacgagaggctgttggccttctctgcatccacgggagagcctgccgcgaagttgagtctaaagatgcaagggaaaagtggaccgcatgagattcggtgcgtgaagcgcaacttcctactggagactctggagaacgaactgccggaaggcaccatcaggttctcttccaagatcgtctcgattgaggaagacggcaatgtcaagctcctacatttgtccgatggctcaacgataagagcaaaggtgctgataggctgcgacggcgtgaactcggtggtggcgaagtggcttggcctgccaaagccgatcctctcagggcgctcggccaccaggggcctcgctgagtacccggccggccacggattcggcccggagatcctgcagttcatcggccagggcttccgctccggcgtgctcccctgttccgacacctccgtctactggaactacacctggtacccctccccggatgacggcgacgcggaggagagcgtggccaagatgcggagctacgtggtggcgaagctgagggcggcgaggatcccggcggaggcgctggacgtgatcgagcggagcgagatgagcgacgtggtgtcgtcgccgctgaggttccggtcgccgctcgcgctcgtccgcggcagcatcagcaggggcaacgtctgcgtcgccggcgacgccttccacccgacgacccccgagctcggccagggcggctgcgcggcgctcgaggacggcgtcgtcctcgcccggtgcctcagcgaggccttcctcgccgacggcgccgagcacgacccggggtacgaggccgtcaaggcggcgctggagaagtacgccgaggagaggcggtggcgcggcatccggctgatcacggcggcctacgtcgtcggcttcatccagcagagcaccaacccggtgatcaagttcctcagggagaagttcttgtcaggattgctggcaaaaactatgatcgccatggctgattacgattgcggaaagctatgattctgttcacgagaaatcaagaacccaagaagagaagaaagaaatcagcggtgagcgggaaccgtctttaattagcacatggagcaatcttgtgatgttgttaaccaagcacgagggggcgagcttaaagtccaccgtacaacgtactagtatcacacactcggcagatgctcaaggcaaagtcttatgtacggggaagagtaggagagagtggagagagtatgagaggtagggccgtatcaggggtattttggcagattatttatgtatctatgctttacaaattaacatgttcgataaattagtgatgtatgtagtgaatctccatttgttgaggtatttgtttggac

SEQ ID NO: 240 - DNA, 1183 bp, Pennisetum glaucum
ggcaacaacaagcgcaaagccatggaggccgtcgaggacgtcgtcatcgccggcgccgggctcgccgggctcgcgacggcactcgggctacacaggaaaggggtgaggagcctggtgctggagtcgtcgccgatgctgcgcgcgtcggggttcgcgttcacgacatggaccaacgccttccgcgcactcgatgccctcggcgttggggacaagatccgggagcaccatctgctctacgagaggatgattaccttctctgctgccactggcgaacctgctgcgaaagtaagcctgaagattcaggggaaaagggggccacacgagaaccggtgcgtgaagcgggacttcctgctgcagacgctcgagaacgagctgcccaagggcaccatcaggtactcgtccaagatcgtcgccattgaggaagacggcaacgtcacagtgctgcacttggctgacggttccatcataagaaccaaggttctgatcgggtgcgacggcgtgaactccgtggtggcgaaatggctgggtctcccgaagccgatcctctcggggcgctccgccaccaggggcctcgccgagtacccggccggccatggcttcggccccgagatcctgcagttcatcggccaaggcttccgctccggcgtcctcccctgctccgacacctccgtctactggaactacacctggtacccttccccagctgacggggacgccgaggagagcgtggccaagatgcggagccacgtgctgggcaagctgcgcgccgccaagatcccggcggcggcgctggacgtgatcgagcggagcgagatgagcgacgtggtgtcgtcgccgctgcggttccggtcgccgctcgcgctcctccgcggcagcatcagccggggcggcgtgtgcgtggcgggggacgcgctccacccgatgacgcccgagctcgggcagggcgggtgcgcggcgctcgaggacggcgtcgtcctggcccggtgcctgggcgaggccttcccggccaccagcagcgccggccacgatggggccatcagggcggcacttgaaaagtacgccgaggagaggcggtggcggagcatccagctcatcacggccgcctacgtcgtcggcttcatccagcagagcaataatatcgtcgtcaagttcatgagggacaccttcctgtcgccgttgctag

SEQ ID NO: 241 - DNA, 1799 bp, Sorghum bicolor
gttcctctgttctctcgcggtctcgccatcccaagaagaggcacgcacgggcacgagaggaaggtggggagaaagaaaaccacagccgcttcaggcgggcgctcaccctgctcctccctcctcgcctggcctcgccatggcggcggcttccagcaggtggaccccggcggccgggctcctgctgctgctcctcctcctcgtcccgttcgccgccatcccgtcccgcgccgccacgccggcggcgtcgtccaccgccatcttccagctccagggcaacgtctatcccaccggccactactatgtcacgatgaacattgggaacccggcgaagccctacttcctggacgtggacactggcagtgatctcacctggctgcagtgcgacgcaccctgtcggagttgcaacaaggtgccacatcccttatatcgaccaacggcaaacagccttgtgccatgtgcaaatgcactctgcactgcacttcacagtggacatggctctaataacaaatgtccttcaccgaaacaatgtgactatcagataaagtacactgatagtgcatcttctcaaggtgtgctgatcaacgacaacttctcactgcccatgagatcctccaacattcgtcctggcctcacatttggctgtggatatgaccagcaagtggggaaaaatggagctgtgcaggcagcgactgacggcatgcttgggcttgggaggggatcagttagcctcgtttcacagctcaagcagcaagggatcaccaagaatgtccttggccattgcctcagcacgaatggaggggggttcctcttctttggcgatgatattgtgcctacatcacgtgtaacttgggtaccgatggcgaagatatctgggaactactactcacctggctcaggaacattgtacttcgatagacgttcacttggcgtgaagccaatggaggtggtatttgacagtggtagcacctatacctattttactgctcagccataccaagctgttgtttctgcgctcaaaagtggtctcagcaaatcacttaaacaggtgtcagatcccagtctgcctctgtgctggaaaggtccgaaagcattcaaatctgtgtttgacgtcaagaaggaattcaagtcactgtttctgagctttgccagtgccaagaatgccgtcatggagatccctcctgaaaactacctcattgttacaaaaaatggaaatgtgtgcttgggcatccttgatggagcggctgccaagctgaatttcaacgtaattggagacatcacgatgcaggatcagatggtgatatatgacaatgagaagtcacagctgggatgggcgcgtggggcatgcactaggagtgccaagtctatcatgtcttcctttccctgaactcagttctttgtacttctgatgactttgagaaaatcaatatatcaaaaaactcctcgggatgcatgaatttcctaactgaagagtgccagcttatgttgaacggaataaagattagtttggattactaaaaggctataggtttcttcagagagagagagggagagagagagagagagagagagagagagagagagagagagagagagagagagagagagagagagagagagagagagtataggagtgaagtttagataggcagataggaagttactaacagtggctgtatgctcctcctgttcatatagaagtggagtccgtaatttgtaaggctcatctgagttgttctccatatgctattaatgatacaggagagctgcttatttcgttattacaatgctttaagcatagg

SEQ ID NO: 242 - DNA, 2069 bp, Panicum virgatum
caccatccctcctcgaggcagaggaagagggaggaaaaactctaagcggtcaagccgcgccgcgggcgcccacaccactcctccctcctgccctctcctcctcgtcccgccatggccgccgcgctcctcctggcggtcctcctcccgctcgtggccaccccgtcccgcgccgccgcaccggcggcgagggcggcctccaccgccgcgttccagctccacggcgacgtctaccccacaggccactactatgtcacaatgaaccttgggaacccggcgaagccctacttcctggacgtggacaccggcagcgacctcacatggcttcagtgcgacgcaccctgccggagctgcaacaaggtgccgcacccattgtatcggcctgcacagaacaggcttataccttgtgcagattctctttgcactgcacttcacagtggactgggcactaacaataagtgcccttcaccaaaacaatgtgactaccgaatcaagtacacagacagcgcatcatctcaaggtgtgcttatcaatgacaacttctcgctgcccttgagcaagtcctccaacattcgtcccagcctgacctttggctgtgggtatgatcagcaagtgggaaaaaatggtgcagtgcaagcagtgacagatggcttgcttgggctagggaggggatcagttagccttctttcacagctcaagcaacaaggggtcaccaagaatgttcttggccattgcctcagtacgaagggaggggggttccttttctttggggatgatattgtgcctacgtcacgcgtaacttgggtacctatggctcggagcacatctgggaactactactcagctggctcaggatcgctgcagtttgatgggcgttcactaggcgtaaagcctatggaggtcgtatttgacagtggtagcacctatacctactttactgcccagccataccaagctgttgtctctgcgctcaagggtggtctcagcaaatcacttaaacaggtgtcagatcctgagctgcctctgtgctggaaagggcaaaaggcattcaaatctgtgtttgacgtcaagaaggaattcaagccactgtctctgagctttcccaatgccaagaatgctgtcatggacatccctcctgaaaactacctcgttgtcactaaaaatggaaatgcgtgcttgggcatccttgacggaacggcagctaagctgagtttcaacgtaattggagacatcacgatgcaggatcagatggtgatatatgataatgagaaagcgcagattggatgggtgcgtggaccatgcagtaggagtgccaagtctattctgtcttcctttccatgaccatttcccatattagaaccatgggctcttgaatccgtttccgtatactgctgctggagtttgtgaaaattactatcatcaaaactcctcggaacgatcaacttcccaactgaagagtgccagcttgttactgtcggaataatgcgtggtacatgtgaggcggatgagattataggagtaaaggttagagaggcaataggaagttactaacagtggctgtatgcattgcaatagtacaaataaatttttgtccaaaaaatcaaataaactgagtggccaaatatttggttaatgaaatgaacagaggacaagtgtgggttgctttttgtgattgcagagagtcctgatgtattgcagttcatgtatatagtaactttcaagagttagtagtgctctgtagattaggtataaaacatttaaacctgatggcatttattttgagaaggatttctcactaaaattcaaatcatgatttgcttgacaatcacttgaaacgtgtactaattaatttctaataatttactgataaaggataaataatttgcacagatctgatcgttttcactgtttctagaagtacatatacataggaggtttatactcaatatattgaaagagcacacttgaattgtgtgtgcttatgtatcctaagatcgtgactccagagacaattttctaattgtatcagatgacgtgtacagaaaccatttttgcatttactctgattttcc

SEQ ID NO: 243 - DNA, 1338 bp, Echinochloa colona
acacgacgactgggggaggaaaactccaaggcgcgtcgcaggcgtccacactgctccctcatctcctcctcgcctcgccatggccgccgccgccaggcgtgccccggtcgccgtgctgctcctggcggccctcctcctcctcctgctcgcggccacgtcccgcgccgccacgcccccgaggccggcgtccaccgccgtcttccagctccacggcgacgtataccccacaggacactactatatcacggtgaacattgggaacccggcgaagccctacttcctggatgttgacaccggcagcgacctcacgtgggtgcagtgtgacgcgccttgccagagctgcaacaaggtgccaaaccaatggtatcggcctacgccgaacaggcttgtgccgtgcgcagactcgctttgcactgcacttcacaatgagctcggcgctaataacaagtgcccttcaccaaaacaatgcgactaccgaatcaagtacgcagacaacgcatcatctcaaggtgtgctcatcgccgacaacttcacgctgaccatgatcaagtcctccaccgttcgtcccagcctgacctttggctgtgggtatgatcagcaagtgggaaaaaatggcgcggttcaagcacccacagatggcttgcttgggcttggcaggggatcagtgagccttctttcacagctcaagcagcaaggaatcaccaagaatgttcttggccattgcctgagcacgaacggaggggggttcctcttctttggggatgatattgtgcctacgtcacgtgtaacctgggtgccaatggctcggactacatctgggaattactactcacctggctcaggaacattgtattttgatagacgttcccttggtgtgaagcctatggaggtcgtatttgacagtggtagcacctatacttactttactgcacagccataccaagctgttgttctcgcgctcaaagctggtctcagcaaatcacttaaacaggtgtctgatcccgaattgcctctgtgctggaaagggcagaaagcattcaaatctgtgtttgacgtcaagaaggaattcaagtcactgtttctgagctttggcactggcaagaatgccgtcatggagattcctcctgaaaactacctcgttgtcactaaaaatggcaatgcatgcttgggcatacttgatggaacgaccgctaagctgagcttcaacgtaattggagacatcacaatgctggatcagatggtgatatatgataatgagaaagcacagctcggatgggtgcgtgcagcatgcagtaggagcgccaagtcaattatgtcttcctttccatgaccatttcc

SEQ ID NO: 244 - DNA, 2793 bp, Setaria italica
cccacgcagcagaggaggaaggggggaagaaaaaaaaccgcagccgtctcgggcgcccacactgctcctccctcctcgccatggccgccgcagccatgcgtgccccgaccgccgtgctcctcctggcggtcctcctcccgttcgcggccgccccgtcccgcgccgctacgctggcgacgtcgccgtcggcctccacctccaccgccgcgttccagctccacggcgacgtctaccccacaggccactactatatcacgatgaacattggggacccagcgaagccctacttcctggacgtggacactggcagtgacctcacatggctgcagtgcgacgcgccctgccagagctgcaacaaggtaccgcacccattgtatcggcctgcaccgaagaagcttgtaccgtgtgcagactctctttgcactgcacttcacagtggacttggctctggtaacaggtgcccttcaccgaaacaatgtgactaccgaatcaagtacacagacagcgccacgtctcaaggtgtactcatcgccgacaacttctcgctgcccttgagcaagtcctccaccgttcgtcccagcctgacctttggctgtgggtatgatcagcaagtcggaaaaaatggtgagaagccagcagtgacagatggcttgcttgggcttgggaggggatcagttagccttctttcacagctcaagcagcaagggatcaccaagaatgtcctcggccattgcctgagcacgaacggaggggggttcctcttctttggggacggtattgtgcctacatcacgcgtaacttgggtgccaatggctcgaagtacatctgggaactactactcacctggctcaggaacactgtattttgataagcgttcactaggcctgaagcctatggaggtcgtatttgacagtggtagcacgtatacatactttactgcccagccataccaagctgttgtttctgcgctcaaaggtggtctcagcaaatcacttaaacaggtaccaggcgacgaactgcctctgtgctggaaaggacagaaggcattcaaatccgtgtttgacgtcaagaaggaattcaagtcactgcatctgagctttgccactggcaagaatgccgtcatggagatccctcctgaaaactacctcattgtcactaaaattggaaatgtgtgcttgggcatccttgatgcaactgtggctaagctgagcttcagcgtaattggagatatcacgatgctggatcagatggtgatatatgataatgagaaagcgcagctcggatgggtgcgcggaccatgcagtaggagcgccaagtcaattctgtcttccatcccatgaccatttcccatatctgaactatgagcccctaaatccatttctgtgtactgctgatggaatcaatgaaaattaccaatatcataagaactccatgcgatgatcaatttccaacggaagagtgctagctttttaccatcggaataaagtttatattaacatgacaggggaatgagagattttagtagtgaaggttagctagcgaggcagataaggaagttactgacagaagctgtatgttccttctgtttataatgagatggaatcccatcattcgtaaggttggtctgagttattctctgtatgccctttacttgaacctcctctggatttcctttttgagttattcttctgtttattccattgcaataatacagatgaatttatgtacaaataaaggtaaataaactgaaagaccaaagaattggttggataattgagtgcagaaagtgcgggttgccttttgtgattgcagagggtccagcttttgtagatagttactaagagttagtaacactcatctggcgattacccctagaagacgggcggaacccccgcgccgccaccacaagccctcgcgtcgatcctccgcctcctcgccgccgcccgagctctcgaccggaaacccgcgccggtgccaggacggcggcggggggctccttttcctccttttttccgcttctcctcgcgagctccctccagcttgctctagttggcggccacagcctcgtcgccgggcttcttctggggctagatccggcgagtctgaggccggatccggagagcccatgggcggatctgacgttcccgttgggttaggcgctcgtggacgcggtgctgctgttgaggccatgtgtggcagcgcggcggcggcggcggcggtggctggcttgggtccggcggaggcccctccctccccgttctcctccctcgccgctacacgtgcaggccagcggaggcccgtccggctgcaagaggcggcgacgaggtcctcttccctcgcaatggcggggccctcctccgtatctgcgtgtccgcgggctcagcggccggccgatcgtttccggttaaccggcgccagatcccacattcccctggtctgatctactccctccgtgggtggatctgggcttctggctgtggagggcagcgacagggtccgtggacgcggcgggcggcggcggcggtggcgcaaggaagcaagcgcgtgtgcaggagcagggcaaatgcactgcacattatcactgcccaactgcccatcgaccacatatttagtggtagctatctccaaatagatagcacatatatagcagatgccccagtatacccgggcgctcaagtcagcagtgcattcaattgagcaaaactacagttgcatagatgctctgaaattggatgcctatttccttaaaaaacttctgaatgggttgttgaaacttttgacttcttataaatg

SEQ ID NO: 245 - DNA, 4894 bp, Setaria italica
gttaaacggggaaagcgcacgcacgcaccccaagaagaacgcacgggaatccgctcggcgttggagcgggattggcaggggattagcatttaggaattaggaggcggcggcgggggagaagccgagtaggaagaggaggaggaggaggaggaggaggaggaggaggaggggtacggagatggacgcggcgggggacatccagaaggtggcgagcatgcggcggggggacagcgggtccatgtggcggcgcggggacgacgtgttctcgcgctcgtccagggaggaggacgacgaggaggcgctgcggtgggccgcactcgagaagctgcccacctacgaccgcgtccgccgcgccatcgtcccgctcggcctcggcggcgacggcgccgaggccgcgggcggcgggaagggggtcgtcgacgtcgacgtgctcagcctcggcccgcagcagcgccgggcgctgctggagcgcctcgtgcgcgtcgccgacgaggacaacgagcgcttcctgctcaagctcaaggaccgcgtcgacagggtcgggatcgacatgcccacgatcgaggtgcggttccagaacctcgaggcggaggccgaggtgcgcgtcggcagcagcggcctccccaccgttctcaactccatcgtcaacacggtcgaggaagcggcgaacgcgctgcacttactgcccagtaggaagcggacgatgcccatcctccacgacgtcagcggaatcatcaagcctcgcaggatgacccttctgttaggcccacccggatcagggaagaccactttgctgctcgcgttggccggaaggcttgacaaagacctcaaggttacgggcaaagtgacctacaatgggcacgagatgacggagtttgttccagagaggacggccgcgtacatcagccagcatgacctccacatcggagagatgactgtgagggagacgcttgcattctcagcacgttgccagggtgttggctcccgctttgatatgctgactgagctatcgaggcgagagaaggcggccaatatcaagcctgatgctgatattgatgcattcatgaaggcatctgcaatgggcgggcaagaggccaatgtggtcactgactatattctgaagatattaggactagagatatgcgcggacacaatggtaggggatgagatgctcaggggcatatctggtggacaacgaaaacgtgttacaaccggcgagatgctggttggtccagccagggcgctttttatggatgagatctcgactgggcttgatagctccactacattccagatcgtgaactcactcaggcagtccatccacatcctcggtggcacagctgtcatctccttgcttcagccagcacctgagacatacaatctgtttgatgacatcatcctcctctcagatggccaggttgtgtaccagggccctcgagaagaagttcttgagtttttcgagtccctgggtttcagatgccctgagaggaagggtgttgctgacttcttgcaagaagtgacttcgaaaaaagatcagaaacagtactgggcgcggcgtgatgagccctacaggtttgtgccggtgaaggaatttgcaactgcgttcaagtcattccacgctgggagggctatagcaaatgaacttgctgttccattcgacaagagcaaaagccacccagccgcactaaccaccacgaggtatggtgtgagtggcaaggagctgctgaaagcaaacatagacagggagatccttctcatgaagaggaactcttttgtctacatgttcagaactttccagctgatgctgatgtcaataattgcaatgactctcttcttccgaacgaagatgaagcatgacacagtgaccgatgggggcctctacatgggtgctctcttctttggcgtgcttatgatcatgtttaatggtttctctgagctggcactcactgtcttcaagctgcctgtattcttcaaacagagggatctccttttctttccggcatggtcctacactataccctcatggatcctcaagatacctatcacatttatcgaggttggcggttatgtgtttttgacatactatgtcattggatttgacccaaatgtcggcaggttcttcaagcagtatctgcttctgttagcagtcaatcagatggcagcagcactcttccggtttattggtggggcagcgaggaacatgattgttgctaatgtctttgcgtcgtttatgttgcttgttgtcatggtgttgggaggatttattctagtaagagaaaaaataaagaaatggtggatctggggctactggatctccccaatgatgtatgcgcagaatgccatttcagtgaatgagatgttggggcacagctgggacaaaatattgaatgccactgcctccaatgagaccctaggtgtgcaagtccttaagtcccgtggagttttcacagaagcaaagtggtactggattggctttggtgcaatggttgggttcaccatactcttcaatgctctcttcactcttgcccttacataccttaaaccatatggcaactcgcggccatcagtatctgaagaggagctgaatgagaagcatgccaacatgaaaggcgaggttctggatggcaatcacttggtatctgcaagaagtcatcgatcaacaagagccaacactgaaactgattcagcaatcggggaagatgattcttccccagctaaaagggggatgatccttccatttgtcccgctttcactcacgtttgacaacatcagatactctgttgacatgccacaggaaatgaaagcacaaggtgtacaagaagatcgtctggagctcctcaaaggtgtcagtgggtcttttaggcctggtgtgctgacggcactaatgggcgtcagtggtgcaggaaaaactactttgatggatgtgctggctgggagaaagacaggtggatacattgaaggagacatcagcatttcaggatacccgaagaaacaagagaccttcgcgcgcatatcaggatactgtgaacaaaatgatatccactcgccacaggtgacagtctatgagtcactgcttttctcagcatggctccggcttcccaaggatgtagattcaaacacaagaaagatcttcattgaggaggtgatggagcttgtggagctcaaaccactgagggattctttggttggacttcctggagtgaatggcctgtcaactgagcagaggaaaaggctcaccattgctgtggagcttgttgcaaatccgtcaatcatctttatggatgaaccaacctcagggcttgatgcccgggcagctgcaattgtgatgcggacggtgaggaacactgtcgatactggtaggacggtggtctgcacgatacatcagcctagcattgacatatttgaagcattcgatgagcttttcctgatgaagcgtggtggagaagagatctatgctggtccacttggccatcattcttcagagcttatcaagtatttcgaggggattcaaggggtcagcaaaattaaagatggctacaatccggcaacatggatgctggaagtgactacagtctctcaggaacagattcttggtgtggacttcagtgagatatacaagaactctgaactgtaccagaggaacaaagccttgataaaggaactaagccaaccagcaccaggttcaagtgacctgcatttccctagcaagtacgcgcagtcttccatcacacaatgcatggcttgcctgtggaagcagaacctgtcatactggagaaaccctccttacaataccgttaggttctttttcaccaccatcattgctcttctcctgggcaccatcttttgggaccttggtggcaaagtgaaaacgtcacaagacttgttaaacgccatgggatcaatgtactctgcggtgctgttcatcggtgtcatgaactgtacctcagttcagccagtggtggctgtggagcggactgtcttttaccgtgaaagagctgcgggcatgtactcagctttcccatatgcatttggccaggttgtcatcgagctcccttacgcattggctcaagatatcctatacggtgtcatagtgtactcgatgatcggcttcgagtggacggctgccaagttcttctggtacctcttctttgggtacttcacgctgctctacttcacattctacggcatgatggccgtcggcctgacaccaaactaccacatcgcctcgatcgtgtcctcagcgttctacgccatctggaacctcttctctgggttcatcatcccgcgtcctagagtgccgatttggtggaggtggtactgctggatatgccccgtggcgtggacgctgtatgggctggtggtgtcgcagttcggcgatatgatgacggagatggacaacggcaagaccgtgaaggtgttcatcgaggactacttcgacttcaagcacagctggctggggtgggttgccgcagtggtcgtggcgttcgcggttctctttgctgccctgttcggcttcgccatcatgaagctcaacttccagaagagatgattacgatattcgagctaggaatgatgtcctgaacaagggattttacattggttcggtcgcaagtaacatttggttgtgcatattagcggggtacaccatgtctatagattcattaattagttataagctatagaagctttcgtgtttctttttaggaggatgatggcgtagtattttgtaaagagtatttcacttctggtaatttttgtaagctgagtagcgcatcgcaatgcactatcagttggagaaggcaaggaaaacacttcatgcctcgttcatctttttttgttgggcctacattgatatccactattcagaatactgcaagaacattacgaaagaatc

SEQ ID NO: 246 - DNA, 4578 bp, Zea mays
ggtgcggggcgcggattggtaggggtgcaggaggcggcggcagcagcagggatagcgagatggacgcggcgggggacattcagaaggtggcgagtatgcggcgaggggacagcggctccatgtggcggcgaggcgacgacgtgttctcacgctcgtcaagggaggaggacgacgaggaggcgctccgctgggccgcgctagagaaactgcccacctacgaccgcatccgccgcgcaatcgtcccgctcggcctcggcgacgaggcgcccggcagcaaggggctcgtggacgtcgacgtgctcagcctcggcccgcgcgagaggcgggcgctgctggagcgcctggtccgcgtcgccgacgaggacaacgagcgattcctactcaagctcaaggaccgcatcgacagggtcggtatcgacatgcccacgatcgaggtgcggttccagaaccttgaggcggaggcggaggtgcgcgtcggcagcagcggcctccctaccgtcctcaactccgtcgtcaacacggtcgaggaagcggcgaacgcgctgcacatactgcccagtaggaagcagatcatgcctattctccacgacgtcagcgggattatcaagcctcgcaggttaacacttttgttgggtccgcctggatcagggaagaccactttgttgctcgctttggccggaaggcttgacaaagatctcaagttttcaggcaaggtgacctataatggtcacgagatgacagagtttgttcctgagaggacggccgcatacatcagtcagcatgacctccacataggagagatgactgtgagggagacgcttgcattctctgcacgctgccagggtgttggctcccgtttggatatgctgactgagctgtcgaggcgagagaaggctgccaatatcaagcctgatgctgatattgatgcattcatgaaggcgtctgcactgggtgggcaagatgctaatgtggtcactgactatattctgaagatattaggactagatatatgtgcagacacaatggtaggggatgagatgctcaggggcatatctggtggacaacggaagcgtgttacaactggtgagatgctggttgggccagccagggcgcttttcatggacgagatctcaactgggcttgatagttcgactacatttcaaattgtgaactcgctgaggcagtccattcacatcctcggtggcacagctgttatctccctactgcagccggcacctgagacttataacttgttcgatgacatcatactcctctcagatggtcaggttgtctatcagggtcccagagaagaagtggttgagtttttcgagtctgtaggtttcagatgccctgagaggaagggtgtcgctgatttcctgcaagaagtgacttcgaaaaaagatcagaaacagtactgggcgcgacctgatgagccctacaggtttgtgtctgtgaaggaacttgcgactgcattcaagtcatcccacacagggagagctttagcaaatgagcttgctgttccgttcgataagagcaaaagccacccagccgcactaaccaccacaaggtatggtgtgagtggcaaggagctgctcaaagcaaacatagaccgggagatccttctcatgaagaggaactcttttgtctacatgttcagaaccttccagctgatggtgatgtcaatcattgcaatgactctcttcttccgtacgaagatgaagcatgacacagtgaatgacgggggtatctatatgggcgcactcttctttggtgtgcttatgatcatgttcaatggcttatctgagctggcgctaactgtcttcaagctgcctgtattcttcaagcagagggatctccttttctttccggcatggtcctacactatacctgcatggatcctcaaggtacccatcacatttatcgaggttggcggttatgtattcttgacatactatgtcattgggttcgacccaaatgtcggcaggttcttcaagcagtatctgcttctgctagcagtcaatcagatgacagcagcactcttccggtttgttggtggggtatcgaggaacatgattgttgctaatgtcttcgcatcgttcatgttgctggttgtcatggtgttgggaggatttattctacaaagagataaagtgaaaaaatggtggatctggggctactggatctccccaatgatgtatgcacaaaatgcaatttcagtgaatgagatgttgggtcacagctgggacaaaatattgaatagcactgcatccaacgagaccctaggtgtgcaagtccttaagtcccgtggagtattcccagaagcaaagtggtactggattggctttggtgctatggttgggttcaccatactcttcaacgctcttttcactcttgcccttacataccttaagccatatggcaactcccggccatctgtatccaaagaagagctgaaggagaagcatgcaaacatcaaaggggaggttgtggatggcaatcacttggtatcagtcaaccctgaaactgattcagcaatcatggaagatgattctgcctcgactaaaaagggaatgatcctcccatttgtcccgctctcggtcacctttgacaacatcaaatactctgtcgacatgccacaggaaatgaaaggacaaggtgtacaagaagatcgtttggagctcctgaaaagtatcagtggatcttttaggcctggtgtgctgactgcactgatgggcgtcagtggtgcaggaaaaactactttgatggatgtgttagctgggagaaagactggtggctacattgaaggagacatccgcatttcaggatacccgaagaaacaagagacctttgcacgtgtatcaggatactgtgagcaaaatgatatccactcgccacaggtgacagtctatgagtccctgcttttctcagcatggctccggcttcccaaggacgtcgattcaaacaaaagaaagatcttcattgaggaggtgatggagctcgtggagctcaaaccactgagaaatgctttggttggacttcctggagtgaatggtctgtcaactgagcagaggaaaaggcttaccattgctgtggaacttgttgcgaatccatcaatcatctttatggatgagccaacctcagggcttgatgcccgagcagctgcaattgtgatgcggacggtgaggaacactgttgatactggtagaactgtggtctgcacgatacatcagcctagcattgacatatttgaagcatttgatgagcttttcctaatgaagcgtggtggggaagagatctatgctggtccacttggacataattcttcagaactaatcaagtattttgaggagattcaaggggtcagcaaaattaaagatggctacaatccagcaacatggatgctggaagtgaccacaatttctcaggaacagattctaggtgttgatttcagtgacatatacaagaaatctgaactctaccagaggaacaaggccttgataaaggaattgagccaaccagcaccaggttcaactgacctgcatttctctagcaagtacgcgcagtctttcaatacacaatgcgtggcttgcctgtggaagcagaacctgtcatactggaggaaccctccttataataccgttaggttctttttcactggcataattgctctcctccttggcaccatcttttgggacctaggcagcaaagtgtatacatcacaagatttgttaaatgccatgggatcaatgtactctgcggtgctgttcatcggggtcatgaattgtacctcagttcagccagtggtggccgtggagcggacagtcttttaccgtgaaagagctgccggcatgtactcagctttcccatatgcgtttggccaggttgtcattgagctcccatacgcactggctcaggatatcttatacgctgtcatagtgtactccatgatcgggttcgagtggacggttgctaagttcttctggtacctcttctttgggtacttcacgctgctctacttcacattctatggaatgatgaccgtcgggctgacgcctaactaccacatcgctgcgatcgtctccgcggcattctacgccatctggaacctcttctccggattcgtcatcccccgaccgaaagtgccgatctggtggaggtggtactgctggatatgccccgtggcgtggacgctgtacgggcttgtggtgtcacagtacggtgacatcatgacggagatggacgacaaaaggaccgtgaaggtgttcgttgaggattacttcgacttcaagcacagctggctggggtgggtggccgccgtggtggtggcattcggggtgctctttgctaccctgtttgcctttgccatcatgaagcttaacttccagaagagataacgacgataggagatcggaaatcacctcctggataagtgattttgcattggttgggtcgtgcatgtagattgggcttgtgcatattctgctccttttctgggaggatgatggtgtagtattttgtaaagaatagtttgcgcatctagtaaattctgtaagcgtgtagtcccttacaaaggatcag

SEQ ID NO: 247 - DNA, 4741 bp, Panicum virgatum
gcgggattggtagcggagtaggaggcggcggcaggggaggaaggaggaggaggagggatacggagatggacgcggcgggggacatccagaaggtggtgagcatgcggcgggggaacagcggctccatgtggcggcgcggggacgacgtgttctcgcgctcgtccagggaggaggacgacgaggaggcgctgcggtgggccgcgctcgagaagctgcccacctacgaccgcgtccgccgcgccatcgtcccgctcggcgacggcgccgaggcgggcggcgggaaggggctcgtcgatgtcgacgtgctcagcctcggcccgcagcagcgccgcgcgctgctggagcgcctcgtgcgcgtcgccgacgaggacaacgagcgcttcctgctcaagctcaaggaccgcgtcgacagggtcgggatcgacatgcccacgatcgaggtgcggttccagaacctcgaggcggcggcggaggtgcgcgtcggcagcagcggcctccccaccgtcctcaactccatcgtcaacacggtcgaggaagcggcgaacgcgctgcacttgctgcccagcaggaagcggaccatgcccatcctccacgacgtcagcggaatcatcaagcctcgcaggatgacccttctgttaggcccacccggatcagggaagaccactttgctgctcgcgttggctggaaggcttgacaaagacctcaaggttagtggcaaagtgacctacaatgggcacgagatgacagagtttgttccagagaggacggccgcgtacatcagccagcatgaccttcacatcggagagatgactgtgagggagactcttgcattctcagcacgttgccagggtgttggctcccgctttgatatgctgactgagctgtcgaggcgggagaaggcggccaatatcaaacctgacgctgatattgatgcattcatgaaggcatccgcaatgggtgggaaagaggccagtgtgatcactgactatatcctgaagatattaggactagagatatgcgcagacacgatggtaggggatgaaatgctcaggggaatatctggtgggcaacgaaagcgtgtgacaaccggtgagatgctggttggtccagccaaagcactttttatggacgagatctcgactgggcttgatagctccactaccttccagattgtgaactcactcaggcagtccatccacatcctcggtggcacagcggtcatctccttgcttcaaccagcacctgagacatataatctgttcgatgacattattctcctctcagacggccaggttgtgtaccagggccctcgagaagaagttatcgagttttttgagtccatgggtttcagatgccctgagaggaagggtgttgctgacttcttgcaagaagtgacttcgaaaaaagatcagaaacagtactgggcacggcgtgatgagccctacaggtttgtgacggtgaaggaattcgcaatggcattcaagtcattccacacagggagagctatagaaaatgagcttgctgtcccattcgacaagagcaaaagccacccagccgcactaaccaccacgagatatggcgtgagtggcaaggagctgctgaaggcaaacatagaccgtgagatccttctcatgaagaggaactctttcgtctacatgttcagaaccttccagctgatgctgatgtcaatcattgcaatgactctcttcttccgtacgaagatgaagcatgacacagtgaacgatgggggcctctacatgggcgcactcttctttggcgtgcttatgatcatgttcaatggcttctctgagctggcactcactgtgttcaagctgcctgtattcttcaagcagagggatctccttttctttccagcatggtcctacactataccctcatggatcctcaagatacccatcacatttattgaggtcggaggttatgtattcttgacatactatgttattggcttcgacccaaatgttgggaggttattcaagcagtatctgcttctgttagcagtcaatcagatggcagcggcactctttcgctttataggtggggtagcaaggaacatgattgttgctaatgtctttgcatcattcatgttgctggttgtcatggtgttgggaggatttattctagtaagagaaaaaataaagaaatggtggatctggggttactggatctccccaatgatgtatgcgcagaatgccatttcggtgaatgagatgttggggcacagctgggacaaaatattgaatagcactgcctccaacgacaccctaggtgtgcaaacccttaagtcccgtggagtattcccagaagcaaagtggtactggattggctttggtgcaatgattgggttcaccatactcttcaatgctctcttcactcttgcccttacatacctcaaaccatatggcaactctcggacatcagtatctgaagaggagctgaaggagaagcatgccaacataaaaggcgaggttctggatggaaatcacctggcatcagcaagcagtcatcgaccaaaaggaatcaacaatgaagctgatccagcaatcgtggaagatgattctgccctgactaaacggggaatgatactcccatttgtcccgctctcactcacctttgatgacatcagatactctgttgacatgccacaggaaatgaaagcacaaggtgtacaagaagatcgtctggagctcctcaaaggtgtcagtgggtcttttaggcctggtgtgctgaccgcactaatgggcgttagtggcgccggaaaaactactttgatggatgtgttggccggaagaaagacaggtggatacattgaaggagacattagcatttcaggatacctgaagaaacaagagaccttcgcacgcgtatcaggatactgtgaacaaaatgatatccactcgccgcaggtgacagtctatgagtcactgcttttctcagcgtggctccggcttcccaaggatgttgattcaaacaaaagaaagatcttcattgaagaggtgatggagcttgtggagctcaaaccactgagggatgctttggttggactccctggagtgaatggtctgtcaactgagcagaggaaaaggcttaccattgctgtggaacttgttgcaaatccgtcaatcatcttcatggatgagccaacctccgggcttgatgcccgggcagctgcaattgtgatgcggacagtgaggaacactgtcgatactggtaggactgtggtctgcacgatacatcagcctagcattgacatatttgaagcattcgatgagcttttcctgatgaagcgtggtggagaagagatctatgctggtccacttggccatcattcttcagagcttatcaagtatttcgagggaattcaaggggtcagcaaaattaaagatggctacaatccggcaacatggatgctggaagtgactactgtctctcaggaacatattctaggtgttgatttcagtgagatatacaagaaatctgaactcttccagaggaacaaggccttgataaaggaactaagccaaccagcgccaggttcaagtgacctgcatttccctagcaagtacgcgcagtcttccatcacacaatgcatggcttgcctgtggaagcagaacctgtcatactggaggaaccctccttacaataccgttaggttctttttcactactgtcattgctctcctcctcggcagcatcttttgggaccttggcggcaaagtgaaaacatcacaagacttgttaaacgccatgggatcaatgtactctgcggtgctgttcattggtgtcatgaactgtacctcagttcagccagtggtggctgtggagcggactgtcttttaccgtgaaagagctgcgggcatgtactcagctttcccatatgcattcggacaggttgtgatcgagctcccatacgcactggctcaggatatcctatacggtgtcatagtgtactctatgatcggcttcgagtggactgctgccaagttcttctggtaccttttctttgggtacttcacactgctctacttcacattctacggcatgatggctgttggcctgacaccaaactaccatatcgcctcgatcgtgtcctctgcgttctatgccatctggaacctcttttctgggttcatcatcccacgaccgaaagtgccgatttggtggaggtggtactgctggatatgccccgtggcgtggacactgtatggactggttgtgtcacagttcggtgacatgatgtcacggatggacgatggcaggactgtgaaggtgttcgtcgaggactacttcgacttcaagcacagctggctggggtgggtggccgctgtggtcgtggggttcgcagttctctttgctgcgctgttcggtttcgctatcatgaagctcaacttccagaagagatgatgacaacataggagctaggaatcatgcccatttctatagattcattaattacttgattattagctaagctatagaagcctttgtcttccttcttaggaggatggcgtggtattttgtaaagagcatttcacttctggtaaaaattttgtaagccgaggaacccatagcaattgcactatctgttggagaaggcaaggaaaacaccacatgcctcattggcttgagcattctttttttttttgggcctacgttggtattcagaatactgcacgaacatgccagagaaaggatcctaaaacctgggtggtcttgctttc

SEQ ID NO: 248 - DNA, 4677 bp, Sorghum bicolor
acgctctcccattgtcaagcgggtgtcagctccgcattgtggtggtaaaggggggaggaggagggatagcgagatggacgcggcgggggacatccagaaggtggcgagtatgcgacggggaggcagcgtctccatgtggcggcgcggcgacgacgtgttctcgcggtcgtccagggaggaggacgacgaggaggcgctccgctgggccgcactggagaagctgcccacctacgaccgcgtccgccgcgccatcgtgccgctcgacctcggggccgacggagccgaggcgcccggccggaaggggctcgtggacgtcgacgtgctcagcctcggcccgcgcgacaggcgggcgctgctggagcgcctcgtccacgtcgccgacgaggacaacgagcgattcttgctcaagctcaaggaccgcgtcgacagggtcgggattgacatgcccacgatcgaggtgcggttccagaaccttggggcggaggcggaggtgcgcgtcggcagcagcggcctgcccaccgtcctcaactccgtcgtcaacacggtcgaggaagcggcgaacgcgctgcacatactgcccagtaggaagcagatcatgcccattctccacgacgtcagcggaatcatcaagcctcgcaggttgacacttctgctaggtccgcctggatcaggcaagaccactttcttgctggccttggccggaaggcttggcaaagacctcaagttttcaggcaaagtgacctataatggtcatgagatgacagagtttgttccagagaggacggcagcgtacatcagccagcatgacctccacataggagagatgactgtgagggagacgcttgcattctctgcacgttgccagggtgtcggctcccgttttgagatgttgactgagctgtcaaggcgagagaaggcggccagtatcaaacccgatgctgatattgatgcattcatgaaggcgtctgcaatgggtgggcaagatgccaatgtggtcactgactatattctaaagatattaggactagagatatgtgcagacacaatggtaggggatgagatgctcaggggcatatctggtggacaacggaagcgtgttacaactggtgagatgctggttgggccatcgagggcacttttcatggacgagatctcaactgggcttgatagttccactacattccaaattgtgaattcactcaggcagtccattcacatcctcggtggcacagctgttatctccctactgcagccagcacctgagacatataacttgttcgatgacatcatactcctctcagatggtcaggttgtctaccagggcccccgagaggaagtgcttgagttttttgagtcagtaggtttcagatgccctgagaggaaaggtgttgctgacttcctgcaagaagtgacttcgaaaaaagatcagaaacagtactgggcgagacttgatgcgccctacaggtttgtgtctgtgaaggaatttgcaactgcatttaagtcattccacacggggagagctatagcaaatgagcttgctgttccgttcgacaagagcaaaagccacccagccgcactaaccaccacaaggtacggcgtgagtggcaaggagctgctcaaagcaaacatagaccgcgagatccttctcatgaagaggaactcttttgtctacatattcagaaccttccagctggtgctgatgtcaatcattgtaatgactctcttcttccgtacgaagatgaagcatgacacaataactgacggcggtatctacctgggtgcagtcttctttggtgtgcttttgaccatgttcaatggcttctctgagctggcgttaactgtcttcaagctgcctgtattcttcaagcagagggatctccttttctttccagcatggtcctacactataccctcatggatcctcaagatacccatcacatttatcgaggttggcggttatgtattcttgacatactatgtcattgggttcgacccaaatgtcagcaggttcttcaagcagtatctaattctgttagcagtcaatcagatggcagcagcactcttccggtttattggtggggcatcgaggaacatgattgtttctaatgtcttcgcatcgttcatgttgctggttgtcatggtgttgggaggatttattctacaaaaagataaaattaagaaatggtggatctggggctactggatctccccaatgatgtatgcacaaaatgccatttcagtgaatgagatgttgggtcacagctgggacaaaatattgaatagcactgcctccaacgagaccctaggtgtgcaaagcctcaagtctcgtggagtattcacagaagcaaagtggtactggattggctttggtgctatggttgggttcaccatactcttcaatgctctcttcactcttgcccttacataccttaagccatatggcaactcctggccatctgtatctgaagaggagctgcaggagaagcatgccaacatcaaaggggaggttctggatggcaatcacttggtatcagcaagcactcatcaatcaacaggggtcaacactgaaactgattcagcaatcatggaagatgattctgtctcgacaaaaaagggaatgatcctcccatttgacccgctctcgcttacctttgacaacatcaaatactctgttgacatgccacaggaaatgaaagcacaaggtgtacaagaagatcgtttggagctcctcaaaggtgtcagtgggtcttttaggcctggtgtgctgacagcactgatgggcgtcagtggtgcaggaaaaactactttgatggatgtgttagctgggagaaagacaggcgggtacattgaaggagacatccgcatttcaggatacccaaagaaacaagagacctttgcacgtgtatcaggatactgtgaacaaaatgatatccactcgccgcaggtgacagtctatgaatccttgcttttctcagcatggctccggcttcccaaggacgtcgattcgaacaaaagaaagatcttcattgaggaggtgatggagcttgtggagctcacaccactgagaaatgctttggttggacttcctggagtgaatggtctgtcaactgagcagcggaaaaggcttaccattgctgtggaacttgttgcaaatccatcaatcatctttatggatgagccaacctcagggcttgatgcccgagcagctgcaattgtgatgcggacggtgaggaacactgttgataccggtagaactgtggtctgcacgatacatcagcctagcattgacatatttgaagcatttgatgagcttttccttatgaagcgtggtggagaagagatctatgctggtccacttggacatcattcttcagatcttatcaagtatttcgaggggatccaaggggtcagcaaaattaaagatggctacaatccagcaacatggatgctggaagtgaccgcaacttctcaggaacagattctaggtgttgatttcagtgacatatacaagaaatctgaactctaccagaggaacaaggtgttgataaaggaattaagccaaccggtgccaggttcaagtgacctgcatttcgctagcacgtatgcacagtcttccattacacaatgtgtggcttgcctgtggaaacagaacctgtcatactggcggaatcctccttacaataccgttaggttctttttcactaccatcattgctctcctccttggcaccatcttttgggacctaggtggcaaagtgtccacatcacaagatttgatgaatgccttgggatcaatgtactctgcggttctgttcatcgggatcatgaattgtacctcagttcagccagtggtggccgtggagcggacagtcttttaccgcgaaagagctgctggcatgtactctgctttcccttatgcctttggccaggttgtcattgagctcccatacgcattggttcaggatattctatacggtgtcatagtgtactccatgatcgggtttgagtggacagctgccaagttcttctggtacctcttctttgggtacttcacactgctctacttcacattctacggcatgatggctgtcgggctgacacctaactatcacatcgcctcgatcgtctcctccgcattctacgccatctggaacctcttctccgggttcatcatcccccgaccgaaaacaccgatctggtggaggtggtactgctggatatgccctgtggcatggacgctatacgggctggtggtgtcacagttcggtgacatcatgactccgatggacgacaacaacaggaccgtggtggtgtcacagtatgtcgaggactactttggcttcaagcacagctggctgggttgggtggccgccgtggtcgtggcattcgcggtgctctttgcgaccctatttggctttgccatcatgaagctcaacttccagaagagataatgacgataggagctgggaaatcacctcctggacaagggattttgcattcgttgtgtcgtgcaagtagatttgattgtgcatattgggagagtccgccaaatctatgtattctttggttagttaaatggagtatatgagtaccagaagactacaagtacatgtgaaagaatcataaaaacctggtcttgctttcatgtttctttggttccacatgcccattgaaatac

SEQ ID NO: 249 - DNA, 4752 bp, Panicum virgatum
gtgaaggagggatacgggagatggacgcggcgggggacatcgtgaaggtggcgagcatgcggcgggggaacagcggctccatgtggcgccgcggggaggacgtgttctcgcgctcgtccagggaggaggatgacgaggaggcgctgcggtgggccgcgctcgagaagctgcccacctacgaccgcgtccgccgcgccatggtcccgctcggcgacggcgccgaggcgggcgcgggcggcgggaaggggctcgtcgacgtcgacgtgctcagcctcggcccgcagcagcgccgtgcgctgctggagcgcctcgtgcgcgtcgctgacgaggacaacgagcgcttcctgctcaagctcaaggaccgcgtcgacagggtcgggatcgacatgcccacgatcgaggtgcggttccagaacctcgaggcggaggcggaggtgcgcgtcggcagcagcggcctccccaccgtcctcaactccatcgtcaacacggtcgaggaagcggcgaacgcgctgcacttactgcccagtaggaagcggaccatgcccatcctccacgacgtcagcggaatcatcaagcctcgcaggatgacccttctgttaggcccacccggatcagggaagaccactttgctgctcgcgttggctggaaggcttgacaaagacctcaaggttagtggaaaagtgacctacaatgggcaagagatgacagagtttgttccagagaggacagctgcgtatatcagccagcatgacctccacatcggggagatgactgtgagggagactcttgcattctcagcacgctgccagggtgttggctcccgctttgatatgctgactgagctgtcgaggcgggagaaggcggccaatatcaaacctgatgctgatattgatgcatacatgaaggcttctgcaatgggtgggcaagaggccagtgtggtcactgactacatcctgaagatattaggactagagatatgtgcggacacgatggtaggggatgaaatgctcaggggcatatctggtggacaacggaagcgtgtgacaaccggtgagatgctggttggtcctgccagggcgctttttatggacgagatctcgactgggcttgatagctccactaccttccagattgtgaactcactcaggcagtccatccacatccttggtggcacagcagtcatctccttgcttcaaccagcgcctgagacatataacctgttcgatgacattattctcctttcagacggccaggttgtgtaccagggccctcgagaagaagttatcgagttttttgagtccatgggtttcagatgccctgagaggaagggtgttgctgacttcttgcaagaagtgacttcgaaaaaagatcagaaacagtactgggcacggcgtgatgagccctacaggtttgtgacggtgaaggaattcgcaatggcattcaagtcattccatacggggagagctatagaaaatgagctttctgtcccattcgacaagagcaaaagccacccagccgcattaaccaccacgagatatggtgtgagtggcaaggagctgctgaaggcaaacatagaccgtgagatccttctgatgaagaggaactctttcgtctacatgttcagaacctttcagctgatgctgatgtcaatcattgcaatgactctcttcttccgtacgaagatgaagcatgacacagtgattgatgggggcctctacatgggcgcactcttctttggcgtgcttttgatcatgttcaatggcttctctgagatggcaatgactgtcttcaaactgcctgtattcttcaagcagagggatctccttttctttccagcatggtcctacactataccctcatggatcctcaagatacccatcacatttatcgaggtcgcaggttatgtattcttgacatactatgtcattggcttcgacccaaatgtcggcaggttcttcaagcagtatctgcttctgttagccatcaatcagatggcagcggcactctttcgctttattggtggggtagcgaggaacatgattgttgctaatgtctttgcatcattcatgttgctggttgtcatggtgttgggaggatttattctagtaagagaaaaaataaagaaatggtggatctgggggtactggatctccccaatgatgtatgcgcagaatgccatttcggtgaatgagatgttggggcacagctgggacaaaatattgaatagcactgcctccaacgagaccctaggtgtgcaaatcctcaagtcccgtggaatattcccagaagcaaagtggtactggattggctttggtgcaatgattgggttcaccatactcttcaatgctctcttcactcttgcccttacatacctcaaaccatatggcaattctcggccatcagtatctgaagaggagctgaaagagaagcatgccaacatgaaaggcgaggttctggatggcaatcacctggcatcagcaagtagtcatcgatcaacaggaatgaacatcgaaactgatccggcaatcgtggaagatgattctgccctgactaaacggggaatgatactcccatttgtcccgctttcactcacctttgataacatcagatactctgttgacatgccacaggaaatgaaagcacaaggtgtacaagaagatcgtctggagctcctcaaaggtgtcagtgggtcatttaggcctggtgtgctgaccgcactaatgggcgtcagtggcgcaggaaaaactactttgatggatgtgttggccggaagaaagacaggtggatacattgaaggagacatcagcatttcaggatacccgaagaaacaagagaccttcgcacgcgtatcaggatactgtgaacaaaatgatatccactcaccgcaggtgacagtctatgagtcactgcttttctcagcatggctccggcttcccaaggatgttgattcaaaaaaaagaaagatcttcattgaagaggtgatggagcttgtggagctcaaaccactgagggatgctttggttggactccctggagtgaatggtctgtcaactgagcagaggaaaaggcttaccattgctgtggaacttgttgcaaatccatcaatcatcttcatggatgagccaacctcggggcttgatgcccgggcagctgcaattgtgatgcggacagtgaggaacactgtcgatactggtaggactgtggtctgcacgatacatcagcctagtattgacatatttgaagcattcgatgagcttttcctgatgaagcgaggtggagaagagatctatgctggtccacttggccatcattcttcagagcttatcaagtatttcgaggggattcaaggggtgagcaaaattaaagatggctacaatccggcaacatggatgctggaagtgactacagcctctcaggaacagatcctaggtgttgatttcagtgagatgtacaagaaatctgaactcttccagaggaacaaggccttgataaaggaactaagccaaccagcgccaggttcaagtgacctgcatttccctagcaaatacgcgcagtcttccatcacacaatgcatggcttgcctgtggaagcagaacctgtcatactggaggaaccctccttacaataccgttaggttctttttcaccaccatcatagctctcctcctcggcagcatcttttgggaccttggcggcaaagtgaaaacatcacaagacttgttaaacgccatgggatcaatgtactctgcggtgctgttcatcggtgtcatgaactgtacctcagttcagccagtggtggctgtggagcggactgtcttttaccgtgaaagagctgcgggcatgtactcagctttcccatatgcatttggacaggttgtcatcgagctcccatacgcactggctcaggatatcctatacggtgtcatagtgtactctatgatcggcttcgagtggacggttgccaagttcttctggtacctcttctttgggtacttcacactgctctacttcacattctacggcatgatggccgttggcatgacaccaaactaccatatcgcctcgatcgtgtcctcagcattctatgctatctggaacctcttctccgggttcatcatcccacgaccaaaagtgccgatttggtggaggtggtactgctggatatgccccgtggcgtggacactgtatgggctggttgtgtctcagttcggtgacgtgttgacacggatggacgatgacaggactgtcaagatgttcgttgaggactacttcgacttcaagcacagctggctggggtgggtggccgctgttgtcgtggggttcgcagttctctttggtgcgctgttcggctttgccatcatgaagctgaacttccagaagagatgatgacgacataggagctaggaatcatgtcctgaacaaaggattttggattggttatgtcgcaagtacatttggctgtgcacattaacggagtacaccatgtctatagattcattaattacttgattattagttaagctatagaagcctttgtcttcctttttaggaggatggcgtagtattttgtaaagagtattttattttgtaaagagtatttcactgctggtaaattttttaagccgagtaacccatagcaattgcactatcagctggagaagccaaggaaaacaccacatgcctcgttgacttgagatttttttttttggcctgcgttgaaattcagaatactgctagaacacgccaaagaatc

SEQ ID NO: 250 - DNA, 5151 bp, Sorghum bicolor
gagcaagcaaagcagcctcccctgtcgtcaaaaaaaaaaaaaaaaaaaaaagaggcggcctccccgggcggcgcggctctgaccgaccggcgcctgtgacgactcacgagccacgaccgcgaggcaaccccgtcccttcccttccgccgtctctcgtcccgtcccaacgcgtcacccctacaaaaaccccaccctgctccgcctgagccctgagcgcgctctcccattgttaagcggggcaagcggacgcacgcacccccaaaacaccggaatctcactggtaaccccggtggcagctcggcgttgtggtgcggggtgcggattggtagggggagcagcagcagcaggaggaggaggcggcggcagcaggggggaggagttggagggatagcgagatggacgtgacgggggagctgcagaaggtggcgagtatgcgtgggggcagcggctccatgtggcggcgcggtgacgacgtgttctcgcgctcgtccagggaggaggacgacgaggaggcgctccgctgggccgcgctggagaagctgcccacctacgaccgcgtccgccgcgccatcgtcccgctcgacctcggggccgacggcgccgaggcggctggcgggaaggggctcgtggacgtcgacgtcctcagcctcggcccgcgcgagaggcgggcgctgctggagcgcctcgtccgcgtcgccgacgaggacaacgagcgattcctgctcaagctcaaggaccgcgtcgacagggtcgggatcgacatgcccacgatcgaggtccggttccagaaccttgaggcggaggctgaggtgcgcgtcggcagcagcggcctccccaccgtcctcaactccatcgtcaacacagtcgaggaagcggcgaacgcgctgcacatactgcccagtagtaagcggatcatgcccatcctccacgacgtcagcggaatcatcaagcctcgcaggttgacacttctgttaggtccgcctggatcaggcaagaccactttgttgctggccttggccggaaggcttgacaaagacctcaagttttcaggcaaagtgacctataatggtcatgagatgacagagtttgttccagagaggacggcagcgtacatcagccagcatgacctgcacataggagagatgactgtgagggagacacttgcattctctgcacgctgccagggtgtcggctcccgttttgacatgttgactgagctgtcgaggcgagagaaggcggccaatatcaaacctgatgctgatattgatgcattcatgaaggcgtctgcaatgggtgggcaagatgccaatgtggtcactgactatattctgaagatattaggactagagatatgtgcagacacaatggtaggggatgagatgctcaggggcatatctggtggacaacggaagcgtgttacaactggtgagatgctggttggaccatcgagggcacttttcatggacgagatctcaactgggcttgatagctctactacattccaaattgtgaattcactcaggcagtccattcacatcctcggtggcacagctgttatctccctactgcagccggcacctgagacttataacttgttcgatgacatcatactcctctcagatggtcaggttgtctaccagggcccccgagaagaagtgcttgagttttttgagtcagtaggtttcagatgccctgagaggaagggtgtcgctgacttcctgcaagaagtgacttcgaaaaaagatcagaaacagtactgggcgaggcttgatgcgccttacaggtttgtgtctgtgaaggaattcgcgactgcatttaagtcattccacacggggagagctatagcaaatgagcttgctgttccgttcgacaagagcaaaggccacccagccgcactaaccaccacgaggtacggcgtgagtggcaaggagctgctcaaagcaaacatagaccgggagatccttctcatgaagaggaactcttttgtctacatattcagaaccttccagctggtgctgatgtcaatcattgtaatgactctcttcttccgtacgaagatgaagcatgactcagtgactgacggtggtatctacctgggtgcagtcttctttggtgtgcttatgatcatgttcaatggcttctctgagctggcgttaactgtcttcaagctgcctgtattcttcaagcagagggatctccttttctttccagcatggtcctacactataccctcatggatcctcaagatacccatctcatttatcgaggttggtggttatgtattcttgacgtactatgtcattgggttcgacccaaatgttggcaggttcttcaagcagtatctgcttctgttagcagtcaatcagatggcagcagcactcttccggtttattggtggggcatcgaggaacatgattgttgctaatgtcttcgcatcattcatgttgctggttgtcatggtgatgggaggattcattctagtaagagataaaattaagaaatggtggatctggggctactggatctccccaatgatgtatgcacaaaatgccatttcagtgaatgagatgttgggtcacagctgggacaaaatattgaatagcgctgcctccaacgagaccctaggtttgcaaagccttaagtcccgtggagtattcacagaaccaaagtggtactggattggctttggtgctttggttgggttcaccctactcttcaacgctctctttactcttgcccttacataccttaagccatatggcaactcccggccatctgtatccgaagaggagctgcaggagaagcatgccaacatcaaagggggcaatcacttggtatcagcaagcagtcatcaatcaacaggactcaacactgaaactgattcagcaatcatggaagatgattctgcctcgactaaaaagggaatgatcctcccatttgacccgctctcgctcacctttgacaacatcaaatactctgttgacatgccacaggaaatgaaagcacaaggtgtacaagaagatcgtttggagctcctcaaaggtgtcagtgggtcttttaggcctggtgtgctgacagcactgatgggcgtcagtggtgcaggaaaaactactttgatggatgtgttagctgggagaaagacaggcgggtacattgaaggagacatctgcatttcaggatacccaaagaaacaagagacctttgcacgtgtatcaggatactgtgaacagaatgatatccactcgccacaggtgacggtctatgagtccttgcttttctcagcatggctccggcttcccaaggatgtcgattcaaacacaagaaagatcttcattgaggaggtgatggagcttgtggagctcaaaccactgagaaatgctttggttggacttcctggagtgaatggtctgtcaactgagcagaggaaaaggcttaccattgctgtggaacttgttgcaaatccatcgatcatctttatggatgagccaacctcagggcttgatgcccgagcagctgcaattgtgatgcggacggtgaggaacaccgttgatactggtagaactgtggtctgcacaatacatcagcctagcattgacatatttgaagcatttgacgagcttttccttatgaagcgtggtggagaagagatctatgctggtccacttggacatcattcttcagatcttatcaagtattttgaggggatccaaggggtcagcaaaattaaagatggctacaatccagcaacatggatgctggaagtgaccacaacttctcaggaacagattctaggtgttgatttcagtgacatatacaagaaatctgaactctaccagaggaacaaggcgttgataaaggaattaagccatccggtgccaggttcaagtgacctgcatttcgctagcacgtacgcacagtcttccatcacacaatgtgtggcttgcctgtggaaacagaacctgtcatactggaggaatcctccttacaatactgttaggttctttttcactaccatcattgctctcctccttggcaccatcttttgggacctaggtggcaaagtgtctacatcacaagatttgatgaatgccttgggatcaatgtacgctgcagtgattttcatcggggtcatgaattgtacctcagttcagccagtggtggctgtggagcggacagtcttttaccgtgaaagagctgctggcatgtactcagctttcccatatgcatttggccaggttgtcattgagctcccatacgcactggttcaggatattctatatggtgtcatagtgtacgccatgatcgggtttgagtggacggctgccaagttcttttggtacctcttctttgggtacttcacgctgctctacttcacattctatggcatgatggctgttgggctaacacctaactatcacatcgcctcgatcgtctcctcggcattctatgccatctggaacctcttctctgggttcatcatcccccgaccgaaaacaccgatctggtggaggtggtactgttggatatgccccgtggcatggacgctgtacgggctggtggtgtcacagttcggtgacatcatgacagagatggacgacaacaacaggactgtggtggtgtcacagtacgttgaggactacttcggcttcaagcacagctggttggggtgggtggcagccgtggtggtagcattcgctgtgctctttgcggccctatttggctttgccatcatgaagttcaacttccagaagagataatgacgataggagctgggaaaatcaccacctggacaagggattttgcattcgttgggtcgtgcaagtaaatttgactgtgtatattgggagagtccgccaaatctatggattctttgattagttaaagttatactagcagttattgctgcttttttgggaggatgatggcgtagtatttaaagaatatttcacacacctactagtaaattttgtaagcttgtagctccttgcaaaggattagttgaaggcaaggaaatacctcgtgtgttgctgttgacttaaagcatatacgtactattttgatacgtgtatatttgacttaaacatatacgtactattttgatacgtgtacatcagtactagaagattgcaagtacatgagaaagaatcatta

SEQ ID NO: 251 - DNA, 4828 bp, Sorghum bicolor
tctcgtcccgtcccaacgcgtcacccctacaaaaacccccaccctccgcctcaactctctcccatcgttaagcgggtggcagctcggcgttgtggtgcggggtgcggattgtggtaacccggtggcagcagctcggcgttgtgttgtggtgcgggttgcggattggtagggggagcactagcaggaggcggcggcggcagcaaggggggggaggagttggagggatagcgacgagatggacgcggcgggggacattcagaaggtggcgagtatgcggcgcgggggcagcggctccgtgtggcggcgcggcgacgacgtgttctcgcggtcgtccagggaggaggacgacgaggaggcgctccgctgggccgcgctggagaagctgcccacctacgaccgcgtccgacgcgccatcgtcccgctcgacggcgacgaggcggccggcgggaaggggctcgtggacgtcgacgtgctcagcctcggtccgcgcgagaggcgggcgctgctggagcgcctcgtccgcgtcgccgacgaggacaacgagcgattcctgctcaagctcaaggaccgcatcgacagggttgggatcgacatgcccacgatcgaggtgcggttccagaaccttgaggcggaggcggaggtgcgcgtcggcagcagcggcctgcccaccgtcctcaactccgtcgtcaacacggtcgaggaagcggcgaacgcgctgcacatactgcccagtaggaagcggatcatgcccattctccacgacgtcagcggaatcatcaagcctcgcaggttgacacttctgttaggtccgcctggatcaggcaagaccagtttgttgctcgccttggctggaaggcttgacaaagacctcaagttttcaggcaaagtgacctacaatggtcacgagatgacggagtttgttccagagaggacagccgcatacatcagccagcatgacctccacataggagagatgactgcgtatgcaatgggtgggcaagatgccaatgtggtcactgactatattctgaagatattaggactagagatatgtgcggacacaatggtaggggatgagatgctcaggggcatatctggtggacaacggaagcgtgttacaactggtgagatgctggttgggccagccagggcgcttttcatggacgagatctcaactgggcttgatagctctactacattccaaattgtgaattcactcaggcagtccattcacatccttggtggcacagctgttatctccctactgcagccggcaccagagacttataacttgtttgatgacatcatactcctctcagatggtcaggtggtctaccagggcccccgagaagaagtgcctgagtttttcgagtcagtaggtttcagatgccctgagagaaagggtgtcgctgacttcctgcaagaagtgacttcgaaaaaagatcagaaacagtattgggtgcgacctgatgagccctacaggtttgtatctgtgaaggaatttgcgactgcatttaagtcattccacacagggagagctatagcaaatgagcttgcggttccgtttgacaagagcaaaagccacccagccgcactaaccaccacaaggtatggtgtgagtggcaaggagctgctcaaagcaaacatagaccgggagatccttctcatgaagaggaactcttttgtctacacattcagaaccttccagctgattctgaattcgatcattacaatgactctcttcttccgtacgaagatgaagcatgacacggtgaatgacgggggtctctacatgggtgcagtcttctttggtgtggttctgatcatgttcaatggcatgtctgagttgtcgcttactgtcttcaagctgcctgtattcttcaagcagagggatctccttttctttcctgcatggtcctacactctaccctcatggatcgtcaaggtacccatcacatttatcgaggttggcggctatgtattcttgacatattatgtcattgggttcgacccaaatgtcagcagattcttcaagcaatatctgcttctgttagcagtcaatcagatggcagcggcactcttccggtttattagtggggcatcgaggaacatgattgttgctaatgtctctgcatcgttcatgttgctggttgtcatggtgttgggaggatttattctacaaaaagataaaattaggaaatggtggatctggggctactggatctccccaatgatgtatgcacaaaatgccatttcagtgaatgagatgttgggtcacagctgggacaaaatattgaatagcactgcctccaacgagaccctaggtgtgcaaagcctcaagtctcgtgcagtattcacagaagcaaagtggtactggattggctttggtgctatggttgggttcaccatactcttcaacgctctcttcactcttgcccttacataccttaagccatatggcaactcccggccatctgtatccgaagagcagctgcaggagaagcatgccaacataaaaggggaggttctggatgctaatcacttggtatcagcattcagtcatcgatccacagatgtcaacactgaaactgatttagcaatcatggaagatgattctgcctcgagtaaaaagggaatgatcctcccatttgacccgctctcgctcacctttgacaacatcaaatactctgttgacatgccacaggaaatgaaagcacaaggtgtacaagaagatcgtttggagctcctcaaaggtgtcagtgggtcttttaggcctggtgtgctgaccgcactgatgggcgtcagcggtgcaggaaaaactactttgatggatgtgttagctggaagaaagacaggagggtacattgaaggagacatccgcatttcaggatacccaaagaaacaagagacctttgcacgtgtatcaggttactgtgaacaaaatgatatccactcgccgcaggtgacagtctatgagtccctgcttttctcagcatggctccggcttcccaaggacgtcgattcaaacaaaagaaagatcttcattgaggaggtgatggagcttgtggagctcaaaccactgagaaatgctttggttggacttcctggagtgaatggtctgtcaactgagcagaggaaaaggcttaccattgctgtggaacttgttgcaaatccgtcaatcatctttatggatgagccaacctcagggcttgatgcccgagcagctgcaattgtgatgcggacggtgaggaacactgttgatactggtagaactgtggtctgcacgatacatcagcctagcattgacatatttgaagcatttgatgagcttttccttatgaagcgtggtggagaagagatctatgctggtccacttggacatcattcttcagagctaatcaactatttcgaggcgattcaaggggtcagtaaaattaaagatggttacaatccagcaacatggatgctggaagtgaccacaacttctcaggaacagattctaggtcttgatttcagtgatatgtacaagaaatctgaactctaccagaggaacaaggcgttgataaaggaattaagccaaccagcgccaggttcaagtgacctgcatttccctagcaagtacgcacagtcttccattacacaatgtgtggcttgcctgtggaaacagaacatgtcatactggaggaaccctccttacaatactgttaggttctttttcactaccatcattgctctcctccttggcaccatcttttgggacctaggcggcaaagtgtctacacaacaagatttgatgaatgccatgggatcaatgtactctgcagtgctgttcatcgggatcatgaattgtacctcagttcagccagtggtggctgtggagcggacagtcttttaccgtgaaagagctgctggcatgtactcagctttcccatatgcgtttggccaggttgtcattgagctcccatacgcactggttcaggatattctatacggtgtcattgtgtactccatgatcgggttcgagtggacggctgccaagttcttctggtaccttttctttgggtacttcacgctgctctacttcacattctacggcatgatgactgtcgggctgacacctaactaccacatcgcctcgatcgtctcctcggcattctacgccctttggaacctcttctccgggttcatcatcccccgaccgaaaacaccgatctggtggaggtggtactgctggatatgccccgtggcgtggacgttgtacgggctggtggtgtcacagttcggtgacatcatgactccgatggacgacaacaggcccgtgaaggtgtttgtcgaggactacttcgacttcaagcacagctggctgggttgggtggccgccgtggtcgtggcattcacggtgctttttgcgaccctgtttgcctttgccatcatgaagcttaacttccagaagagataatgacgataggagctaggaaaatcacctcctggacaaggaattttgcattcgttgggtcgtgcaagtagatttgactgtcatattgggagagtacgccatatctatggattcgttgattagttaaagttataagctattgtgctgctttttttttgagaggatattgcgctccttttctgggggtgatggcatagtattttgtaaagaatatttcgcacatctagtaaattttataagcttgttgcctcttgcaaaggatcagttggagaagacaaggaaatacctcgtgcgttgctgtttacttataagtatatacgtactattttgatacgtatatgtaagtactagaagactgcaagtacatgtgaa

SEQ ID NO: 252 - DNA, 5230 bp, Panicum virgatum
agaacaaaaaacaagtcgccttccagaacagaccagctgtgaagccaagcgatcgacggcgaggcgtcatggcacctcgcacatgccgcgccatgcgcccggattgcgggcccacacctcctctgaggctcttctgaccaccgcgattcgcggagtcgacacgctgatcgcgagccaactgcccacgctccgttccaaccaggcagaggcaggcaaccaccccacctctacaaaaacctcctgcgctgcgccgctgcgcagctagctgtctgtgctctctcccgcttcgccttgattggcagcctcccaccacccacctgatcgagcaagcgcgcgcgcgggcgctctccccgagaatcacattcgaatcccagcccagccgcgcggaatcgtgccggcgggagcaggagcccccggggcgaggagcgcggagggggggtagggagatggacgcgggcggggacatccagaaggcgatgagcatgcggcgcggggacagcggctccttctggcgccgcggggaggacgtcttctcgcgctcgtccagggaggaggacgacgaggaggccctgcgctgggccgcgctcgagaagctccccacctacgaccgcgtccgccgcgccctcgtgcccagcgacctcggcctcgacgacggcgccgaggcgggcggcgggagggggctcgtcgacgtcgacgtgctcagcctcggcccgcagcagcgccgggcgctgctggagcgcgtcgtgcgcatcgccgacgaggacaacgagcgattcctgctcaagctcaaggaccgcatcgagagggtcgggatcgacatgcccaccatcgaggtgcggttccacaacctggaggcggaggcggaggtgcgcgtcgggagcagcggcctccccaccgtcctcaactccatcgtcaacacgatcgaggaagcggcgaacgcgctgcacctgctgcccagcaggaagaggcccatgcccatcctccacgatgtcagtggcatcatcaagcctcgcaggttgactcttctgttaggcccacccggctcaggcaagactacttttctgctcgcgttggcgggaaggcttgacaaaagcctcaagactaaaggcaaggtgacatacaacggccatgagatgacggagtttgttccagagaggacggctgcgtatatcagccagcatgacctccacataggagagatgactgtgagggagacactcgcattctccgcgcgctgccagggtgttggttcacgctttgatatgctgactgagctgtcaaggagagagaaggcggcgaatatcaagcctgatgctgatattgatgcgttcatgaaggcatctgcaatgggcgggcaagaagccaatgtggtcaccgattatattctgaagatattaggactagacatatgcgcagatacgatggtaggggatgagatgctcaggggcatatccggtggacagagaaagcgtgttacaactggtgagatgctggttgggccttccagggcacttttcatggatgaaatctcgactgggcttgacagctccactacattccagattgtgaactcgctcaggcagtccatccacatcctcgctggcactgccgtcatctccctcctgcagccggcgcctgagacttataacttgtttgatgacatcatactcctctcagatggccaagttgtctaccagggcccccgagaagatgtgcttgagttttttgagtccatgggtttcagatgccctgaaaggaagggtgttgctgacttcttgcaagaagtgacttcgaaaaaagaccagaaacagtactgggcgcggcgtgatgagccttataggtttgtgccggtgaaggagtttgcaactgcattcaagtcattccacacagggagagctatagcaaatgagcttgctgttccatttgacaagagcaagagccacccagccgcactaaccaccacgaggtatggcgtgagtggcaaggagctgttgaaagcaaacatagatcgggagttccttctcatgaagaggaactctttcgtttacatattcagaaccttccagctgatggtggtgtcaatcattgcaatgactctattcttccgtacgaagatgaagcatgacacggtagctgatggggggatctacgcgggcgcactcttctttggtgtgcttatgatcatgttcaatggcttcactgagatggcactcactgtcttcaagctgcctgtattcttcaagcagagggacctccttttctttccagcatgggcctacactataccctcatggatccttaagatacccatcacattcatcgaggttggtggttatgtattcatgacatactatgtcattgggttcgacccaaatgttagcaggttcttcaagcactatctccttcttttggcaatcaatcagatgtcagcagctatcttccgatttattggtggcatagcgaggaacatgattgttgctaatgtcttcgcttcattcatgttgctggttttcatggtgctaggaggatttattctagtaagagagaaaataaagaaatggtggatctgggggtactggatctccccaatgatgtatgcgcagaatgccattacagtgaatgagatgttggggcacagctgggacaaaatattggatagcactacctccaacgagaccctaggtgtgcaagcccttaaagcccgtggaatattccccgaagccaagtggtactggattggctttgctgcaatgattgggtatatctttctgttcaacgctctcttcactcttgcccttacataccttaagccatatgggaactctcgaccatcaatctctgaagaggagctgaatgagaagcatgccagcatgaacggtggggttccagacggcaatcacttggcatcaaaaagctctcatcaatcaacaggaatcaacactgacgctgattctaccctgactgaaaaggggatgatcctcccatttgtcccgctttcactcacctttgataacatcagatactctgttgacatgccacaggaaatgaaagcacaaggtatacaagaagatcgtctcgagctcctcaaaggtgtcagtgggtcttttaggcctggggtgctaactgcactgatgggaatcagtggcgcagggaaaaccactttgatggatgtgttggcagggagaaagaccggtgggtacattgaaggagatatcagtatttcaggatacccgaagagacaagagacgtttgcacgcatatcaggatactgtgaacagaatgatatccactcgccgcaggtaacagtctacgaatcactgcttttctcagcatggctgcggcttccggaggatgtagattcaaacaaaagaaagctcttcattgaggaagtgatggagcttgtggagctgaaacagttgagacatgctttggttggacttcctggagtgaatggcctgtcaacagagcagaggaaaagactcaccattgctgtggaactcgtggcaaatccatcgatcatcttcatggatgagccaacctcaggacttgatgcccgagcagctgcaattgttatgcgtgcggtgaggaacactgtcaacactggtaggacagtggtctgcacgatacatcaacctagcattgacatatttgaagcattcgatgatcttttcctgatgaagcgtggtggagaagagatctatgctggtccactaggccatcattcttcagagctgatcaagtatttagaggggattcaaggtgtcagcaaaattaaagatggctacaatccagcaacatggatgctggaagtgacaacagcagctcaagaacacgtgctaggtgttgatttcagtgacatatacaagaaatctgaactgtaccagaggaacaaggccttgataaaggaattaagccaacctgcgccaggttcaagtgacctgtatttccctaccaagtatccgcgctcgtccatcacacaatgcatagcttgcctgtggaagatgaacctgtcatactggaggagccctccatacaataccgttaggttctttttcacaaccataattgctctcctcctaggcaccatcttctgggatcttggcggcaaagtgaggacgtcacaagacttgatgaacgccatgggatcaatgtacgctgcggtgctgtttattggggtcatgaattgtacctcagttcagccgatggtggccgtggagcggactgtcttttaccgtgaaagagctgcgggcatgtactctgctttcccctatgcatttggacagattgtcatcgagctcccgtacgcactggctcaggatgtcgtgtatgggctgatagtgtactcaatgatcgggttcgagtggacggttgccaagttcttctggtacctcttcttcgggtacttcacgctgctctacttcacattctacggcatgatggccgtcggcataaccccaaacgctcacatcgccgcgatcatctcctcggcgttctacgccatctggaacctcttctctgggttcatcgtcccgcgaccgaaagtgccgatctggtggaggtggtactgctgggtatgccccgtggcgtggacgctgtacgggctggtcgtgtcgcagttcggcgacgtgacgacggagatggacgacggcacgaccgtgaaggcgttcattgaggactacttcgacttcaagcacagctggctggggttggtggccgccgtggtcgtggggttcacggtgctgtttggctccctcttcggctttgccatcatgaagctcaacttccagaagagatgatgacgatataggagctggaatcatgtcctgaacaagggattttacattggttatgtcacatatatttcacacgttcggtaaattttgtattatagccgtagaaagtattagcttgagaaggcaagaaaaaaaatacctgatgctttgttgttggcttgagcatttactactctgttaggcctaccttgatgtacgatactgcaggaacattgtgcaaaaatctaaaacctggtctcactcgcatgtttagatatgcgccaaacagtacaaagagagcaatagagatcccaaggaagaacacgggagccttttgtcaacagctgtggatcacagaacgaataatattgggatgaaacgtgacagagtaatcatagtttgaccttctagtagccatcggcaactctgcgttgacgtcaaggcatcttggttcaccg

SEQ ID NO: 253 - DNA, 4806 bp, Setaria italica
caggaaactgggcaagcgcacgcacgcgccccgaaaagtcacattggaatcgcagcgagaaatctcgccagctcgccgggggcgcggattggcgcaggcggaagcaggagagtaggaggcctcgggttggcgatcgagggccgaggagggggtagggagagatggacgcgatggcggacatccagaaggtggtgagcatgcggcgcggggacagcggctccatgtggcggcgcggggacgacgtgttctcgcgctcgtccagggacgaggacgacgaggaggcgctgcgctgggccgcgctcgagaagctccccacctacgaccgcgtccgccgcgccatcgtcccgctcggcctcggcggcgacggcgccgaggccgcgggcggcggtaaggggttcgtcgacgtcgacgtgctcagcctcggcccgcagcagcgccgggcgctgctggagcgcctcgtccgcgtcgccgacgaggacaacgagcgcttcctgctcaagctcaaggaccgcgtcgacagggtcgggatcgacatgcccaccatcgaggtgcggttccacaacctggaggcggaggcggaggtgcgcgtcggcagcagcggcctccccaccctcctcaactccgtcgtgaacacggtcgaggaagtggcgaacgcgctgcacttgctgcccagcaggaagcagaccatgcccatcctccatgacgtcagcggcatcatcaagcctcgcaggttgactcttctgttaggcccacccgggtcaggcaagactacttttctgctcgcgttggcgggaaggcttgacaaagacctcaagactaaaggcaaagtgacctacaacggtcacgagatgacagagtttgtgccagagaggacggctgcgtatatcagccagcatgacctccacataggagagatgactgtgagggagacacttgctttctctgcgcgctgccagggtgttggctcacgcttggatatgctgactgagctgtcaaggcgagagaaggcggcgaatatcaagcctgatgctgatatcgatgcattcatgaaggcatctgcaatgggcgggcaagatgccaatgtggtcactgattatattatgaagatattaggactagacatatgcgcagatacgatggtaggggatgagatgctaaggggcatatccggtggacaaagaaagcgtgttacaactggtgagatgctggttgggccggccagggcgcttttcatggatgagatctcgactgggcttgacagctccactacattccagattgtgacctcgctcaggcagtccatccacatccttggtggcactgctgtcatctccctgctgcagccggcgcctgagacttacaacttgttcgatgacatcatactcctatcagacggccaagttgtctaccagggcccccgagaagatgtgcttgagtttttcgagtccatgggtttcagatgccctgaaaggaagggtgtcgccgacttcttgcaagaagtgacttcgaaaaaagatcagaaacagtactgggcacggcgtgatgagccctataggtttgtgccggtgacgaaattcgcgactgcgttcaagtcattccgcaccggaagagctatagcaaatgagcttgctgttccatttgacaagagcaagagccacccagccgcactaaccaccatgaggtatggcgtgagtggcaaggaactactgaaagcaaacatagaccgggagatccttctcatgaagaggaactctttcgtttacatattcagaacctttcagctgatggtggtatcaatcattgcaatgactgtcttcttccggacaaagatgaagcatgactcagtagctgatggggccctctatatgtctgcactgttctttggtgtgcttatgatcatgttcaatggcttcagtgagatggcactcattgtcttcaagctgcctgtattcttcaagcagagggacctccttttctttccggcatgggcctacacgataccctcatggatcctcaagatacccatcacattcatcgaggtcggtggttatgtattcttgacatactatgtcattgggtttgaccccaatgttggcaggttcttcaagcactatctacttttgttggcaatcaatcagatgtcagcatcgatcttccgatttgtcggtggggtagcgaggagcatgactattgctaatgtctttgcatcattcatgttactggttttcatggttctaggaggatttattctagtaagagataaaataaagaaatggtggatctggggctactggatctccccaatgatgtatgcacagaatgctatatcagttaatgagatgttggggcacagctgggacaaaatattggatagcgctgcctccaatgagaccctaggtgtgcaaacacttaaattccgaagagtattcccagaacccaagtggtactggattggctttggtgcaatgattgggtatatcttactcttcaacggtctcttcactcttgcccttacatacctgaagccatttgggaagtctcggccatcagtatctgaagaggagctgaaggagaagcatgccagcatgactggtggggttccagacgacaatcacttggcatcagaaagctctcatctgtcaacaggaatcaacactgagactgattctgccctgactgaaaaggggatgatcctcccatttgtcccgctttcactcacctttgacaacatcagatactctgttgacatgccacaggaaatgaaagcacaaggtgtcattgaagatcgtttggtgctcctcaaaggtgtaagtgggtcttttaggcctggggtgctgactgcactgatgggcgtcagtggcgcagggaaaactactttgatggatgtgttggcagggagaaagactggtgggtacattgaaggagatatcagtatttcaggatacccgaagaaacaagagacctttgcacgcatatcaggatactgtgaacagaatgatatccactcaccacaggtgacagtctatgagtcactgcttttctcagcatggctccggcttccaggggatgtggatttggacaaaagaaagatcttcattgaggaggtgatggagcttgtggagctcaaacaattgagagatgctttggttgggcttcctggagtgaatggcctgtcaacggagcagaggaaaaggctcaccattgcagtggaacttgtggcaaatccatcgatcatcttcatggatgagccaacctcggggcttgatgcccgagcagctgcgattgttatgcgtgcggtgaggaacactgtcaatactggtaggacagtggtctgcacgatacatcagcctagcattgacatatttgaagcattcgatgatcttttcctgatgaagcgtggtggagaagagatctatgctggtccattaggccatcattcttcagagctgatcaagtatttcgagggaattcaaggagtcagcaaaattaaagagggctacaatccagcaacatggatgctggaagtgacaacagcctctcaagaacacgtgctaggtgttgatttcagtgacatatacaagaactctgaactctaccagaggaacaaggccttgataaaggaattaagccaacctgcgccaggttcgagtgacctgtatttccctagcaagtatccacgctcgtccatcacacaatgcatggcttgcctgtggaagcagaacctgtcatactggagaaaccctccttacaataccattaggttctttttcactaccgtcattgctctcctcctcggcaccatcttctgggaccttggcagcaaagtgttgacaacacaagatttgacaaatgccatgggatcaatgtacgctgcagtgctgttcatcggcatcatgaactgtacctcagttcagccaatggtggccgtggagcgtagtgtcttttaccgtgaaagagctgccggcatgtactcggctttcccatatgcatttggacagattgtcattgagctcccatacacactggctcaggatatcgtatacgggctgatagtgtactctatgatcgggttcgagtggacggttgccaagttcttttggtacctcttctttgcttacttcacgctgctctacttcacattctacggcatgatggccattggcataacaccaaatgcccacatcggtgcgatcgtttcctcggcattctacgccatctggaacctcttctccgggttcatcatcccgcgaccgagaatgcccatctggtggaggtggtactgctgggtgtgccccgtggcgtggtcgctgtacgggctggtggtgtcgcagttcggcgacgtgatgacggtgatgcaagacagcgacggcaggaccgtgaaggcttacatcgaggacacttacggcttcaagcacagctgggtagggtgggtgggcgcggtggtcgtggggttcgccgtgctcttcggcgccctgttcggcttcgccatcatgaagctcaacttccagaagagatgatttgtgaccataggagctgggatgcttgcgtgtcctgcatatacaggagattttgcattggttcggtggaaagtaaagtggctgtgcatattagcagagtacatcatatctgatttgtctggattcgttaattagttaagctatagaagcttttatcctcctttttgggcggatgatggcgtagtaatatttatttgtaaagagtatttcacgtgtctagtaatttttgtactctctccatcccaaattataagtcgctttgacttttttgatacatccattttactat

SEQ ID NO: 254 - DNA, 4893 bp, Brachypodium distachyon
ggtggtttgcgccgctaaatataaccattggcgcgaccatagctagctgcgcgcggggaggaggaggaagatggacgcggcggcggaaatccagaaggtcgccagcatgcggggggacagcgggtccatctggcggcgcggggacgacgtgttctcgcgctcgtcgagggacgaggacgacgaggaggcgctgcgctgggccgcgctcgagaagatgccgacctacgaccgcgtccgccgcgccatcctgccgcggctcgacggcggcggcgacgagggcgcggcggcggggaagggggtcgtggacgtggacgtgcacgggctcggcccgcgcgagcggcgggcgctcctcgagcggctcgtgcgcgtcgccgacgaggacaacgagcgcttcctgttcaagctcaaggaccgcctcgagcgggttgggatcgacatgccgacgatcgaggtgcggttcgagcacctggtggcgtcggcggaggtccgcgtcggcgacagtggcctccccaccgtgctcaactccatcaccaacacgctcgaggaagcggcgaacgcgctgcgcatactccccaacaggaagcggaccatgcccatcctccacgacgtcagtggtatcatcaaaccgcgcaggatgactctgctgttaggcccacctgggtctggcaagaccaccttgctgctcgcattggccgggaggctcgacaaagacctcaaggtttcaggcaatgttacctacaacgggcatgggatggaggagtttgtgccggagagaacggcggcgtacataagccagcacgacctccacataggagagatgactgtgagggagacactcgcgttctccgcacgctgccagggtgttggcaatcgctttgatatgctgactgagttgtcgaggcgagagaaggctgcaaatatcaaacctgatgctgatatcgatgcgtttatgaaggcatcttcaatgggggggctagaggccaacgtgaacacagactatatactgaagatattaggactagagatatgcgcagacacgatggtgggggacgagatgctgaggggcatctctggtggacaacggaagcgtgttacaaccggtgagatgcttgttgggcctgccaaggcgctcttcatggatgagatctccactgggcttgacagctccactactttccagattgtaaactccctccggcagtccgtacacattcttggcggcacggccgtcatctccctgctgcagccggcccctgagacgtacaacttatttgatgacatcctcctcctatcagacggccaggtcgtttaccagggccctcgtgagaatgtgcttgaattcttcgagtccatggggttcaagtgtcctgagaggaagggtgtcgctgacttcttgcaagaggtgacttcaaggaaagatcaaaagcaatactgggcacgggttgatgagccctaccggttcgtgccggttaaggactttgtcagtgcgttccggtcgttccacactgggagagctataacaaacgagctcgctgttccgttcgacaagagcaagagccatccagctgcattgacgaccacgaggtatggtgtgagtggcacggagctgctaaaggcaaacattgacagggagatcctcctcatgaagaggaactcttttgtctacatgtttagaaccttccagctgatcctaatgtcatttatttcaatgacgctcttcttccgtacaagcatgaagcgcgactctgtgaccagtgggggtatctacatgggagcgctcttctttggtgtgctcatgatcatgtttaatggcttctctgagctcgcactcactgtctttaagctgcctgtgttcttcaagcagagggacctccttttctaccctgcatgggcctatgcgataccctcatggatcctcaagatcccaatcacgtttattgaggttggcggctatgttttcataacatactatgtcatggggttcgacccaaatgtaggcaggttcttcaagcaatatctgcttatgttagcaatcaatcagatggcagcatcactcttccgattcataggtggggcagcgaggagcatgattgttgcaaatgtctttgcgtcattcatgttgctaatttttatggtcttgggcggattcattctagtaagagaaaaagtaaaaaaatggtggatttggggctactggatctccccactaatgtatgcacagaacgccatctcagtaaatgagctcttgggtcacagctgggacaaaatcttgaatagcaccgcctcaaacgagacccttggtgtgcaagtcctcaagtcccgtggagttttccctgaagccaagtggtattggatcggtttgggtgcaatgctcggattcaccttattgttcaatgctctcttcactcttgccctgacatacctgaaggcatatggcaactcccgttcgtcggtatctgaagatgaactgaaggagaagcatgccaacctgaacggtgaggttttggacaacaatcacttggaaactcatggaccgtcaggaatcagtactggaaatgattcggcagttgttgaagattctagccctgtgaaaaggggaatggtccttccatttctcccgcttgcactcacctttgaaaacatcagatactctgttgacatgccaccggaaatgaaaacacaaggggtagttgaagatcgattggagctcctcaaaggtgtcagtggatctttcaggcctggggtgctgactgcactgatgggggtcagtggtgctggcaagactactctgatggatgtgttggcagggagaaagacaggtgggtacatcgaaggaaacatcagcatttcaggatacccaaagaaacaagagacatttgcgcgtgtatcaggatactgtgaacagaatgatatccactcgccgcaggtgacagtctatgaatcgctgcttttctcagcatggctccgtcttcccggggatgtagacttaaacaaaagaaagatgttcatcgaggaggtgatggagcttgtggaactcaagcctctgagagatgcattggttggtctacctggagtgaatggtctgtcgactgaacagaggaagaggctgaccattgctgtggagctcgttgctaatccttctattattttcatggacgagccaacgtccggacttgatgcccgagcagctgcaatcgttatgaggacagtgaggaacactgttgatactggtagaactgtggtctgtacgattcatcagcctagcattgacatttttgaagcatttgatgagcttttcctgatgaagcgaggcggagaagagatctatgctggtccattgggtcatcattcttcagagttaatcgagtacttcgaggggatacatggagttggcaaaattaaagatggctacaatccggcaacatggatgctggaagtgacaacaaccggtcaagagcagatgctaggtgttgatttcagtgacatatacaagaaatctgaactctaccagaggaacaaggctttgataaaggaactaagccaacctgcaccaggttcaagtgacctgtatttccctacccagtactcacagtcttcaatcacacagtgcgtggcttgcctgtggaagcagaacctgtcatactggaggaaccccccatacaatgccgttaggttccttttcactaccgtcattgctcttctcttcggcaccatcttctgggaccttggtggcaaaatgagccagtcacaagacttgttcaacgccatggggtcaatgtatgctgcggtgctgttcatcggagttatgaactgtacttcggttcagccagtggtcgctgtcgagaggacagtcttttaccgtgaaagagcagctggcatgtactcggctttcccatatgcatttggccaggttgtcatcgaactcccatacacactggttcaggctaccgtatatggagtcatagtttacgctatgatcgggtttgagtggacagctcctaaattcttctggtaccttttcttcatgtacttcacgctgctatacttcacattttacggcatgatggctatcggcctgacaccgaactaccacatcgcctcaatcgtttcctcggcgttctacgccatctggaatctcttttctgggttcatcatccctcgaccgaaaactccaatctggtggcgatggtactgctgggtatgccccgttgcatggacgctgtacggactggtcgtctcgcagtttggcgatgtcgtgacgcctatggatgacggtacccttgtgaaagacttcatagaagactacttcgacttcaagcacagctggttgggttatgtggccacggtggtcgtggcattcacgttgctgttcgccttcttattcggctttgccatcatgaagctgaacttccagaagagatagacgatgacgataggaagcatgtcttaggaagatattatgttagttgggttgcaaatacgagtggatttgtgcatagcatttgatcacatggaatgtatgggtttattagttatcttctagtagatgatacaggtttttgggaagctgtatactgcattagttcttatttccagcagtcctcttcggcccaacctcaacatatatttcttatgattcttgtgagaactatactgtagttctacacagctgagaattagatcaggacaggacttagacactttgaaactctaatggtatctattgctaaattgccagaaggttctaatgaaaaacatcccaaaaacaatacagaccttttatttaaggagtgcttgcacggttgcaccgggtggagttatatgctctgcttcctacgctctttgtaaactggagaatgtaacaatctttggttaataaagtatcttatactc

SEQ ID NO: 255 - DNA, 4584 bp, Aegilops tauschii
aaacgcgcctgagaaaagcccttggaaatcacgccgacggtggggggttaggggagatggacgcgacggcggaaatccacaaggtcgccagcatgcggcgcgacagcggctccatatggcggcgcggcgacgacgtgttctcgcgatcgtccagggacgaggacgacgaggaggcgctgcgctgggccgcgctcgagaagctgcccacctacgaccgcgtccgccgtgccatcctcccgcctctcgacggcggcgagggcgcggcccccggggcggcggcggggaagggggtcgtggacgtgcacggcctcgggccgcgcgagcgccgggctctcctcgagcgcctcgtgcgcgtcgctgacgaggacaacgagcgcttcctgctcaagctcaaggaccgcctcgaacgggttgggattgaaatgccgacgatcgaggtgcggttcgagcacctggtggcggaggcggaggtccgggtcggcaacagcggcctccccaccgtcctcaactccatcaccaacacgctcgaggaagcggcgaacgcgctgcgcatactccccaacaggaagcggaccatgcccatcctccacgacgtcagtggcatcatcaagccccgcaggatgacactcctgttgggcccacctgggtcaggcaagaccaccttgctgctcgccttggccgggaggctcgacaaagacctcaaggtctcaggcaatgttacctacaacgggcacgggatggaggagtttgtgccggagaggacggcggcgtacataagccagcacgacctccacataggggagatgactgtgagggagacactcgccttctccgcacgctgccagggtgttggcactcgctttgatatgctgactgagttgtcgaggcgagagaaggccgcaaatatcaagccagatgctgatattgatgcatttatgaaggcttcttcaatgggaggtctggaggccaatgtgaacacagactatatactgaagatattaggactagagatgtgtgcagacacgatggttggggacgagatgctcaggggcatctctggtggacaacggaagcgtgttacaactggtgagatgctggttgggccggccaaggcgctcttcatggacgagatctcaactgggctcgacagctcaactacatttcagattgtaaactcactcaggcaatctgtgcacatccttggtggcacagccgtcatctccctgctgcagccagcccctgaaacgtacaacttattcgatgacatcatcctcctctctgatggccaagtcgtgtaccagggccctcgtgacgacgtgcttgaattcttcgagtctgtggggttcaagtgtcctgaaaggaagggcgtcgccgacttcttgcaagaggtgacttcgaagaaagatcaaaagcaatactgggtgcggggtgatgagtcctaccggttcgtgccggttaaagactttgtgcgtgcattccagtcattccacaccgggagagctataagaaaggagctcgctgtgccattcgacaagagcaagagccatccagcagcattgacaactacgaggtatggtgtgagtggcacggagctgctaaaggcaaacattggcagggagatcctcctcatgaaaaggaactctttcgtctacatgtttagaaccttccagctgatcctcatgtcatttattgcaatgactctcttcttccgtacaaagatgaagcgcgactcggtgacaaatgggggcatctacatgggggcactcttctttggtgtgctcatgatcatgttcaatggcttctctgagcttgcactcaccgtctttaagctacccgtgttcttcaagcagagggacctccttttctacccagcatgggcttacacaataccctcatggatcctcaagatcccaataacatttgttgaggttggcggttatgttttcataacatactatgtcatggggttcgacccaaatgtaggcaggttcttcaagcaatatcttcttatgttagcaatcaatcagatggcggcatcactctgccgattcattggtggagcagcaaggaacatgattgttgcgaatgtctttgcatcattcatgctgctcatttttatggtattgggcggattcattctagtaagagaaaaagtgaagaaatggtggatttggggctactggatctccccactaatgtatgcacagaatgccatctcagtgaatgagttcttcggtcacagctgggataaaatattgaatagcacggcctcaaacgagacccttggagtgcaagtcctgaagtatcgcggagtgtttccagaagcaaagtggtactggatcggtttgggtgcaatgctcgggtacaccttgttgttcaatgctctcttcactcttgcccttacatacctgaaggcatacggtaactcccgttcgtcggtatctgaagacgaactgaaggagaagcatgccaacctgaacggtgaggttctggacaatgatcgcatgttatcaccaagcaatgatggaccgatacgaatgaacactggaaatgactcagcaatagtcgaagagaattctagccccatgcaaaggggaatggtgcttccatttctcccgctttcactcacctttgacaacatcagatactctgttgacatgccactggaaatgaaagcacaaggcgtagttgaagaccgattggagctcctcaaaggtgttagtggatctttcaggccaggggtactgactgccctgatgggtgtcagtggtgctggcaagactactctgatggatgtgttggcagggagaaagacaggtgggtacattcaaggaaacatcagcatttcaggatacccgaagaaacaagagacctttgcacgcgtatcaggatactgcgaacagaatgatatccactctccgcaggtgacagtctatgagtcgctgcttttctcagcatggctccgtctccccgaggatgttgattcaaacaaaagaaggatgttcatcgaggaggtgatggagcttgtggagctcaagcctctgaaagatgcattggttggtctaccgggagtgaatggtctgtcaactgaacagaggaagaggctgaccattgctgtggagctcgttgctaatccttctatcattttcatggatgagccaacctccggacttgatgcccgagcagccgcaatcgtgatgaggacagtgaggaacactgttgatactggtagaactgtggtttgcacgattcatcaacctagcattgacatatttgaagcatttgatgagctattcctgatgaagcgaggtggagaagagatctatgctggtccattgggccatcattctgcagacttaatcaattactatgagggcattcatggggtcagcaaaattaaagatggctacaatccggcaacatggatgttggaagtgacaacgatcggtcaagaacagatgctaggcattgatttcagtgacatatacaagaaatctgaactctaccagagaaacaaggcattgataaaggaacagagccaacccgcgccgggttcaactgatctgtatttccctacccagtactcgcagtcttcgatcacacaatgcatggcttgcctgtggaagcagaacctgtcatactggaggaaccctccttacaatgccgttaggttccttttcactactgtgattgctctcctcttcggcaccatcttctgggaccttggtggcaaaatgagccagtcacaagacttgttcaacgccatggggtcaatgtatgctgcagtgctgttcattggtattatgaactgtacttcggttcaaccagtggtggctgtggagaggacagtcttttaccgtgaaagagcagccggcatgtactcagcattcccgtacgcatttggccaggttgtcattgaactcccatacacactcgctcaggctaccgtatacggagtcatagtttactcgatgattgggtttgagtggacagctcctaaattcttctggtacctcttcttcatgtacttcacgctgctctacttcacattctacggcatgatggctgttggcctgacacccaactaccacatcgcctcaatcgtctcgtcagcattctacgccatctggaatctcttctcaggattcatcatcccccgaccaaaagttccaatctggtggagatggtattgctgggtatgccccgtagcgtggacactgtacgggctggttgtctcacagtttggcgatgtcacaacgccaatggaggacggcactcccgtgaaagactttatagagggctacttcgacttcaagcacagctggttaggttatgttgctacggtggtcgtggcgtttgcggtgctgtttgccttcttgttcggttttgccatcatgaagctcaacttccagaagaggtagatgatgacgatatgaggcatgttctagaaagaaatgcattagttgcccgcaaatatgaatcgatgtgtacatatcatttgaccacatggaatgtttaggttcattagttatcttgtactagtacatcatagaggtctatcttttggaaacattttgcaccacc

SEQ ID NO: 256 - DNA, 4746 bp, Oryza sativa
tcggcgaggaggttttggtggtggtgggagatggacgcggcgggggagatccagaaggtggcgagcatgcggctaggggggagcatgaggggggacagcgggtcgatgtggaggagaggggacgacgtgttctcgaggtcgtcgagggaggaggacgacgaggaggcgctgcggtgggcggcgctcgagaagctgcccacctacgaccgcgtgcgccgcgccatcctgccgctcggtggcgacgacggcgccggggacggaggagggaagggcgtcgtggacgtgcacgggctcggcccgcgcgagcgccgcgcgctcctcgagcgcctcgtgcgcgtcgccgacgaggacaacgagaagttcctcctcaagctcaaggaccgcgtcgaccgggtggggatcgacatgccgacgatcgaggtgcggttcgagcacctggaggcggaggcggaggtccgcgtcggcaacagcggcctccccaccgtcctcaactccatcaccaacaccctcgaggaagccggcaacgcgctcggcattctgcccaaccggaagcagaccatgcccgtcctccacgacgtcagcggcatcatcaagccccgcaggatgactctgctgttaggcccaccggggtcaggcaagaccaccttgctgctcgcgttggccggaaggctcggcaaagatctcaaggcttcaggaaaagtgacctacaacgggcacggcatggaggaattcgtgccggagaggacggcggcttacatcagccagcacgacctccacatcggagagatgaccgtcagggagacacttgccttctcggcacgatgccagggtgttggcagtcgctttgatatgttgactgagctgtcaaggcgagagaaggcagcgaacattaagcctgacgccgatatcgatgcattcatgaaggcggctgcaatgggaggacaggaggcaaacgtgaacactgactatatactgaagatattaggactagagatatgcgctgacacgatggttggggacgagatgctgaggggcatctcaggtgggcaaagaaagcgtgttacgactggtgagatgctggttgggccagccagggcgctcttcatggacgagatctcaactgggcttgacagctccactacattccagatagtgaattcgcttaggcaaactgtccacatcctcggtggcacagctgttatctccctgctgcagccggcgcctgagacttacaacttgtttgatgatatcatcctcctctcagacggtcagattgtgtaccagggcccccgagaggatgtgcttgaattcttcgagtccatggggtttaagtgtcctgacaggaagggtgttgccgacttcttgcaagaagtgacttctaagaaagatcaaaggcagtactgggcgaggcatgacaagccctacaggtttgtgacggttaaggaatttgtgagtgcattccagtcgttccacacagggagagctatagcaaacgaacttgctgttccgtttgataagagtaagagccatcctgccgcactggctaccacaaggtacggtgctcctggcaaggagctgctgaaggcaaatattgacagggagattctcctcatgaagaggaactctttcgtctacatgttcagaaccttccagttgatggtggtgtcactcattgcaatgacactcttcttccgtacgaaaatgaaacgtgattctgtgaccagcgggggcatctacatgggcgcactcttctttggtgtgcttatgatcatgttcaatggtttctcagagcttgcgctcactgtctttaagttgcctgttttcttcaagcagagggatctccttttttatcctgcatggtcgtacactataccctcatggattctcaagatcccaatcacgtttattgaggttggtgggtatgtgttcttaacatactacgtcattgggtttgactcaaacgtgggcagcttcttcaagcagtatttgctcatgttagcaatcaatcagatggcgggatcacttttccgattcattggtggggcagcgaggaacatgattgttgcaaatgtctttgcatcattcatgctgctaatttttatggtattgggtggattcattctagcaagagagcaagtgaagaaatggtggatttggggctactggatatccccgatgatgtacgcccagaatgccatctcagttaatgaactcatggggcacagctggaacaaaattgtgaatagctctgcctccaatgagacccttggtgtgcaagtcctcaagtcccgtggagtattccctgaagccaggtggtattggattgggtttggtgcaatgatcggcttcaccatccttttcaatgctctcttcacccttgcccttacatacctcaggccatatggaaattcccgtcagtcagtatcagaagaggaactgaaagagaagcgtgccaatctgaatggtgagattgtgggtgacgttcacttgtcatctggaagtacgcgtaggccaatgggaaacggcactgaaaatgattcaacaattgttgatgatgatactgaggttactcaaagggggatggttctcccatttactccgctttcactcagctttgacaatgtcagatattctgttgacatgccacaggaaatgaaagcacaaggtgtagctgatgaccggttggagctcctcaaaggtgttagtggttcattcaggccaggggtgttgactgcactaatgggtgtcagtggtgctggcaagacaacactgatggatgtattggctgggagaaagacaggtgggtacattgaaggaagcatcaacatttcaggatatccaaagaaacaagagacttttgcacgtgtgtctggatactgtgagcagaacgatatccactcaccgcaggtcacagtctatgagtcgctacttttctcagcatggctccgtcttcctgaggatgtagattccaacactagaaagatgttcattgaggaggtgatggagcttgtggagctcaagtcactgagagatgctttggttgggcttcctggagtgaatggtctgtccactgaacaaagaaagaggctaacaatcgcagtggagcttgttgcaaacccttcgattatattcatggacgagccaacctcagggcttgatgcacgagcagctgcaattgtgatgaggacagtgaggaacactgttaatactggcagaactgtggtgtgcacaattcatcagcctagcattgacatatttgaagcatttgatgagcttttcctgatgaagcgaggtggtgaagagatctatgctggtccactaggccatcattcttcggagctgatcaagtattttgagagtatcccaggggtcagcaaaatcaaagatggctataacccagcaacatggatgttggaggtgacaacaattggtcaagagcaggcacttggtgttgattttagtgatatatacaagaagtctgaactttaccagaggaacaaggccttgataaaggacctgagccaaccagcccccgattcaagtgacctgtatttccctacccaatattctcagtcttctttaacacaatgcatggcttgcctgtggaagcaaaacctgtcatactggaggaaccctccttacaatgccgttaggttctttttcactactgtcattgctcttctctttggtaccatcttctgggaccttggcggcaaagtgacgaagtcacaagacttgttcaatgccatggggtcaatgtatgcagcagtgctgttcatcggtgtcatgaactgtacatctgttcagccagtggtggccgtggagcggacagtcttttaccgtgaaagggctgccggcatgtactcggcgtttccatatgcatttggccaggttgtcattgagatcccatacacactggttcaggctactgtatacgggatcatagtgtatgcgatgattgggttcgagtggacggctgccaagttcttctggtacctcttcttcatggtcttcacgctcctctacttcacattctacggcatgatggcggtcggcctgacaccgaactaccacattgcctcgatcgtctcatcggcgttctacgccatctggaatctcttctccggcttcgtcatcccccgacctagagtcccaatctggtggagatggtattgctgggcgtgccccgtcgcgtggacgctgtacggcctcgtcgtctcccagttcggtgacatcgagacgccgatggaagacggcacccctgtgaaggtgtttgtggagaactacttcggcttcaagcacagctggttgggctgggtggccaccgtggtcgctgccttcgctttcctcttcgcttccttgtttggcttcgctatcatgaagttcaacttccagaagagatgatgatgacaagggatattacattcattgagttgcaaacgctacctgaaatttgtgcatatcattggatctaaagaatttttttttgttgccattagaatattgtaaatcataccagcctttcccccttatttttatagaaagattgtactactgttacacctagtaattttgttattagtacccttctttttatagaaagatggtactacttttatttttaatttttatatggggttgtctagtgttcagttgactgaactcacattttgctcgatgtaaatgaagaacagttctgctgttcgtcactactatttttgttaattgtattgcccagttttcctc

SEQ ID NO: 257 - DNA, 4551 bp, Setaria italica
ctcgtttgctcgggtagcgccgcggcggccatggacgcggcggcggagatccagaaggtggcgagcatgcgcctggacggcggcttgcggtccgggtcgtcctcggcgtggtggcgcgcgcccgacgtgttctcgcgctcctcgtcgcggagggaggacggggacgacgaggaggaggcgctgcgatgggccgcgctcgagaggctgcccacctgcgaccgcgtccgccgcgccatcctcccgctcggcgagggcggggagacgggcgcgcacgcgcagcaggtggtggacgtgctcggcctcggcccgcgcgagcgccgggcgcttctggagcgcctcgtgcgcgtcgccgacgaggacaacgagcgattcctgctcaagctcaaggagcgcgtcgagcgggtcgggatcgacatgcccaccatcgaggtgcggttcgaacacctcaaggcggaggcggatgtgcgcgtcggcaccagcggcctccctaccgtcctcaactccatcaccaacacgctcgaggaggtcgccagcgcgctgcgcgtgcaccgcagcaggaagcaggcgatgcctatcctccacgacgtcagcggcatcgtcaagccccgcaggatgactctgctgctaggcccgcccgggtcaggcaaaaccaccttgctgctcgccttggccgggaggctcgataaagatctcaaggtttcaggcaaagtgacatacaatgggcatgggatggacgagtttgtgccggagaggacagctgcgtatatcagccagcatgaccttcacattggggagatgactgtcagggagacgcttgaattctctgcacgctgtcaaggtgttggcagtcgctttgatatgctgacggaactttcaaggcgtgagaaggtgggaaacatcaagcccgatgccgatattgacgcattcatgaaggcttgtgcaatgcggggacaagaggctaatgtgatctctgactatatactgaagatattaggtttagacatatgtgcagacacgatggtgggggatgagatgttgaggggcatctccggtggacaacggaagcgtgtcacaacaggtgagatgcttgttggtccagccaatgcgctgttcatggatgaaatttcgactgggcttgacagctcgactacattccagatcataaagtcacttagacaggctatccacatcctcggtggcacggctctcatctccttgctgcagcctgcgcccgagacatatgacctttttgacgacatcatactgctctcggacgggcagattgtgtatcaggggcctcgagaaggcgtgctcgaattcttctggtctcttgggttcaagtgtcctgagaggaagggtgtggctgactttctgcaagaagtgacttcccggaaagatcagaagcagtactgggggcggcacaacaaaccataccaatacgtgtcggttaaggaatttgcatgtgcgttccagtctttccatgctgggagagctatagcaaacgagctagctgttcctttcgacaagagcaagaaccaccccgctgctttgaccacctcgaggtatggtgtcagtgccagagagctgttgaaagcaaacatcgaccgggaaatcttgcttatgaagaggaattccttcgtctacatcttcagaactttgcagttgatgatggtgtccacaatggcaatgactctcttcttccgtacgaagatgcaccgtgactcagtgactgatgggcgtatctacttgggtgcactcttctttgcagtgatcatgatcatgttcaatggattatccgagcttgcactcaccatcattaagctgccagtgttcttcaagcagagagatctcctcttctttccagcatgggcctacaccatacccacatggatcctcaagatcccaatctcttttcttgaggttggtgggtttgttttcatgtcatactatgtcattgggtttgatccaaatgtaggcaggttcttcaagcagtacctccttttgttagcagtcaaccagatggcagcatcactctttcgattcgttggtggggcagcaaggaacatgattgttgcaaacgtctttggatcattcatgctgctaatttttatggtgttgggcggatttattctagtaagagataaagtgaagaagtggtggatatggggttactggatctctccattgatgtatgcccagaatgccatctcagtaaatgagatgttggggcacagctgggacaaaattatgaatagctctgtgtcaaatgagaccctaggtgtgcaatccctgaagtcccgtggagtcttcccagaagcaaagtggtactggatcggcttaggtgcattgcttggatttgtaatgctcttcaattgtctcttcactcttgcactggcatacctgaagccatatggtgagtcccatccatcaatatctgaagaggaactgaaggaaaagtatgcaaacctcaagggtaatgctctggctgaagatagcttggcactgggaagtagccatcgagcaacagttggcatcactggatccggttcagcaactgctgaaaatcattcttgcactaggggtatggtccttccatttgccccgctttctctcactttcaacaacatcaagtactttgttgacatgccacaggaaatgaagacacatggtgtagtcgaggaccggttagagctccttaaaggtgtcagtggatctttcagaccaggagtgttgactgcactgatgggtgtcagtggtgctggcaagacaactctaatggatgtgttggctgggagaaagaccagtggttacattgaaggaaatatcagaatttcaggatacccaaagaaacaaaaaacctttgcacgtgtgtcaggatattgtgaacagaacgatatccactcgccccaggtgacagtctatgagtcgctacttttctcagcgtggctccgccttcctaaggatgtagattcaaacaccagaaagatgttcattgaggaggtcatggagcttgtggagctcaagccgttgagaaatgctttggtggggcttcctggtgtgaatggtctgtcaactgagcagaggaaaaggttgaccattgctgtggagctggttgcaaatccctcaatcattttcatggatgagccaacctctggccttgacgcccgggcagctgcaattgttatgaggacggtgaggaacactgtcgatacaggtagaactgtggtctgcacgattcatcagcctagcatcgacatatttgaagcatttgatgagcttttccttatgaagcgaggaggagaagagatctatgttggtccactaggtcatcgttcttctgagctgattaagtattttgagggaattcaaggagtcaggaaaattaaagatggctacaatccagcaacatggatgttagaagtaacaacagtctctcaagaacagacactaggtgttgatttcagtgacctatacaagaaatctgaactctaccagaggaacagggccttgatacaagagttaagcgaaccgccagcaggttcaagcgaccttcatttccgtaaccagtactcacaatctttcttcatgcaatgcttggcttgcctgtggaagcagaacctctcatattggaggaaccctgcttacaatgccgttaggctatttttcaccaccatcatagcccttatctttggcaccatcttctgggaccttggtggtaaaatggggcaaccacaagatttgtccaacgccatggggtccatgtatgctgcagtgttgttcatcggcgtcttgaatgctatgtctgttcagccagtggtctctgtggagcggactgtgttttaccgcgaaagagccgccggcatgtactcggctttgccatatgcatttggacaggttaccattgaactcccatacactttggcccaggccagcgtctatgggatcatagtgtactcaatgatcgggttcgaatggacggcggcaaaattcttctggtacctcttcttcatgtacttcaccttcctctacttcacattctacggcatgatggctgtcggcctgacgccgagctaccatgtggcctcgatcgtctcctcggctttctatgccatctggaacctcttctccggattcatcatcccgcgaccgaaagttccaatctggtggaaatggtactgctgggcgtgccctgtggcgtggacgctgtacgggctggtcgtgtcgcagttcggcgacatcacgacggcgatggacaacggcgtccccgtgaatgtcttcgtcgagaagtacttcggcttcaagcacagctggctgggcgtggtggccgccgtggtcgtggcgttcgccgtgttattcgcttgccttttcggcttcgccatcatgaagctcaacttccagaggaggtagcgacggtacatgtacatgcaacgtcttgcaagtagaattgcatccattggtttgcaaatacatagtgatttgtgcatattcagtgcagcataccaaatgtttgacttcgctagtgatactgtaaagctaaagggtggtggtttg

SEQ ID NO: 258 - DNA, 4281 bp, Panicum virgatum
ctcacctgcacggctgcacaagcagcgaccgcaccacgcgctggtgtcgtgtcttgggctcttggcaagttggcatccaagcgcggcggaagcgccctcctcccggccccgggccccacacctcgcgagccaaccccctttgaaaccgttccgatccgttccgttccgttccaacgcatcgcccctacaaataccccaccccccaaccctctctcagcactcggcagcctctttccaccgcaaaacggggcaagcgcgcgcacgcacgcacccccagagaacacgcccacagccggaatcgccggggaaacacggtgacagctcaaaattccctcggcgctgggcggggattagtagcggagtaggaggcggcggcaggggagcaggaggaggaggggtacggagatggacgcggcgggggaaatccagaaggtggcgagcatgcggctggggaacagcggctccatatggcggcgcggggacgacgtgttctcgcgctcgtccagggatgaggacgacgaggaggcgctgcggtgggccgcgctcgagaagctgcccacctacgaccgcgtccgccgcgccatggtcccgctcggcggcgacggcgccgaggcgggcgcgggcggcgggaaggggctcgtcgacgtgcacagcctcgacccgcagcagcgccgtgcgctgctggagcgcctcgtgcgcgtcgccgacgaggacaacgagcgcttcctgctcaagctcaaggaccgcgtcgacagggtcgggatcgacatgcccacgatcgaggtgcggttccagaacctcgaggcggaggccgaggtgcgcgtcggcagcagcggcctcccaaccgtcctcaactccatcatcaacacggtcgaggaaacggcgaacgcgctgcacttactgcccagtaggaagcagaccatgcccatcctacacgacgtcagcggaatcatcaagcctcgcaggttaacccttctgttaggcccacccggatcagggaagaccactttgctgctcgcgttggctggaaggcttgccaaagacctcaaggttagtggcaaagtgacctacaatgggcacgagatgacagagtttgttccagagaggacggctgcgtacatcagccagcatgacctccacattggggagatgactgtgagggagactcttgcgttcgcagcacgttgccagggtgttggctcccgctttgatatgctgactgagctgtcgaggcgggagaaggcggccaatatcaaacctgatgctgatattgatgcattcatgaaggcatccgcaatgggtgggaaagatgccagtgtggtcactgactatatgctgaagatactaggactagaggtatgcgcggacacgatggtaggggatgaaatgatcaggggcatatctggtggacaacgaaagcgtgtgacaaccggtgagatgctggttggtccagccagggcgctttttatggatgagatctcgactgggcttgatagctccactaccttccagattgttaactcactcaggcagtcgatccacatcctcggtggcacagcagtcatctccttgcttcaaccagcgcctgagacatataacctgttcgatgacattattctcctctcagacggccaggttgtgtaccagggccctcgagaagaagttatcgagttttttgagtccatgggtttcagatgccctgagaggaagggtgttgctgacttcttgcaagaagtgacttcgaaaaaagatcagaaacagtactgggcacggcgtgatgagccctacaggtttgtgacggtgaaggaattcgcaatggcattcaagtcattccacacagggagaactatagaaaatgagcttgctgtcccattcgacaagagcaaaagccacccagccgcactaacaaccacgagatatggcgtgagtggcaaggagctgctgaaggcaaacatagaccgtgagatccttctcatgaagaggaactcttttgtctacatgttcagaaccttccagctgatgctgatgtcaatcctttcaatgactctcttcttccgcacgaagatgaagcatgactctgtgattgatgggggcctctacatgggcgcactcttctttggcgtgcttttgatcatgttcaatggcttctctgagatggcaatgactgtcttcaagctgcctgtattcttcaagcagagggatctccttttctttccagcatggtcctacactataccttcatggatcctcaagatacccatcacatttatcgaggtcgcgggttatgtattcttgacatactatgtcattggcttcgacccaaatatcagcaggttcttcaagcagtatctgcttctgttagcaatcaatcagatggcagcggcactctttcgctttattggtggggcagcgaggagcatggttgttgctaatgtctttgcatcattcatgttgctggttgtcatggtgttgggaggatttattctagtaagagaaaaaataaagaaatggtggatctgggggtactggatctccccaatgatgtatgcgcagaatgccatttcggtgaatgagatgttggggcacagctggaacaaaatattgaatagcactgcctccaacgagaccctaggtgtgcaaacccttaagtcccgtggagtattcccagaagcaaagtggtactggattggctttggtgctatgattgggttcaccatattcttcaatgctatcttcactcttgcccttacatacctcaaaccatatggcgactctcggccatcagtatctgaagaggagctgaaggagaagcatgccaacatgaaaggcgaagttctggatggcaatcaccgggcttcagcaagcagtcatcgaccaacaggaatcaacactgaagctgatccagcaatcgcagaagatgattctgccctgactaaacggggaatgatactcccatttgtcccgctttcactcgcctttgataacatcagatactctgttgacatgccacaggaaatgaaagcacaaggtgtacaagaagatcgtctggagctcctcaaaggtgtcagtgggtcttttaggcctggtgtgctgaccgcactaatgggcgtcagtggcgcaggaaaaactactttgatggatgtgttggcaggaagaaagacaggtggatacattgaaggagacatcagcatttcaggatacccgaagaaacaggagaccttcgcacgcatatcaggatactgtgaacaaaatgatatccactcgccgcaggtgacagtctatgagtcactgcttttctcagcgtggctccggcttcccaaggatgttgattcaaataaaagaaagatcttcgttgaagaggtgatggagcttgtggagctcaaaccgttgagggatgctttggttggactccctggagtgaatggtctgtcaactgagcagaggaaaaggcttaccattgctgtggaacttgtcgcaaatccgtcaatcatcttcatggatgagccaacctccgggcttgatgcccgggcagctgcaattgtgatgcggacagtgaggaacactgtcgatactggtaggactgtggtctgcacgatacatcagcctagcattgacatatttgaagcattcgatgagcttttcctgatgaagcggggtggagaagagatctatgctggtccacttggccatcattcttcagagcttatcaagtatttcgaggggattcaaggggtcagcaaaattaaagatggctacaatccggcaacatggatgctggaagtgactgcagtctctcaggaacagattctaggtgttgatttcagtgagatgtacaagaaatctgaactcttccagaggaacaaggccttgataaaggaactaagccaaccagcgccaggttcgagtgacctgtatttccctagcaagtacgcgcagtcttccatcacacaatgcatggcttgcctgtggaagcagaacctgtcatactggaggaaccctccttacaataccgttaggttctttttcactactgtcattgctctcctcctcggcagcatcttttgggaccttggcggcaaagtgaaaacatcacaagacttgttaaacgccatgggatcaatgtactctgcggtactgttcattggtgtcatgaactgtacctcagttcagccagtggtggctgtggagcggactgtcttttaccgtgaaagagctgcgggcatgtactcagctttcccatatgcattcggacaggttgtcatcgagctcccatacgcactt

SEQ ID NO: 259 - DNA, 4343 bp, Secale cereale
caacgagcgcttcctgctcaagctcaaggaccgcctcgagcgggttgggattgaaatgccgacgatcgaggtgcggttcgagcacttggtggcggaggcggaggtccgggtcggcaacagcggcctccccaccgtcctcaactccatcaccaacacgctcgaggaagcggcgaacgcgctgcgcatactccccaacaggaagcggaccatgcccatcctccacgacgtcagtggaatcatcaagccccgcaggatgacacttctgttgggcccacctgggtccggcaagaccaccttgctgctcgcgttggccgggaggctcgacaaagacctcaaggtctcaggcaatgttacctacaacgggcacggcatggaggagtttgtgccggagaggacggcggcgtacataagccagcacgacctccacataggggagatgactgtgagggagacgcttgccttctccgcacgctgccagggtgttggcactcgctttgatatgctgactgagttgtccaggcgagagaaggccgcaaatatcaagccagatgctgatatcgatgcatttatgaaggcgtcttcaatggggggtctggaggccaatgtgaccacagactatatactgaagatattaggactagagatgtgtgcagacacgatggttggggacgagatgctgaggggcatctctggtggacaacggaagcgtgttacaactggtgagatgctggttgggccggccaaggcgctcttcatggacgagatctcaactgggctcgacagctcaactacattccagattgtaaactcactcaggcagtctgtgcacatccttggcggcacagccgtcatctccctgctgcagccagcccctgaaacgtacaacttattcgatgacatcatcctcctctctgatggccaagtcgtgtaccagggccctcgtgacgacgtgcttgaattcttcgagtctgtggggttcaagtgtcctgaaaggaagggtgtcgccgacttcttgcaagaggtgacttcgaagaaagatcaaaagcaatactgggcgctgggtgacgagtcctaccagttcgtgccggttaaggaatttgtgcgtgcattccagtcattccacaccgggagagctataagaaaggagctcgctgtgccattcgacaagagcaagagccatccagcagcattgacaaccacaaggtatggtgtgagtggcacggagctgctaaaggcaaacattgacagggagatcctcctcatgaagaggaactctttcgtctacatgtttagaaccttccagctgatcctcatgtcatttatcgcaatgacgctcttctttcgtacaaagatgaagcgcgactctgtaacaaatgggggcatctacatgggggcactcttctttggtgtgctcatgatcatgttcaatggcttctcagagcttgcactcaccgtttttaagctacctgtgttcttcaagcagagggacctccttttctacccagcatgggcctacacaataccctcatggatcctcaagatcccaataacatttgttgaggttggcggttatgtcttcataacatactatgtcatggggttcgacccaaatgtaggcaggttcttcaagcaatatcttcttatgttagcaatcaatcagatggcggcatcactcttccgattcattggtggagcagcaaggaacatgattgttgcgaatgtctttgcatcattcatgctgctcatttttatggtattgggcggattcattctagtaagagaaaaagtgaagaaatggtggatttggggctactggatctccccactaatgtatgcacagaatgccatctcagtgaatgagttcttcggtcacagctgggataaaatattgaatagcacggcctcaaacgagacccttggagtgcaagttctgaagtatcgcggagtgtttccagaagcaaagtggtactggatcggtttgggtgcaatgctcgggtacaccttgttgttcaatgctctcttcactcttgcccttacatacctgaaggcatacggtaactcccgttcatcggtatctgaagacgaactgaaggagaagcatgccaacctgaatggtgaggttctggacaatgatcgcctggaatcaccaagcaatgatggaccaaaacgagtgaacactggaaatgactcagcaatggtacaagagaattctagccccatgcaaaggggaatggtgcttccatttctcccgctttcactcacgtttgacaacatcagatactctgttgacatgccaccggaaatgaaagcacaaggcgtagttgaagaccgattggagctcctcaaaggtgttagtggatctttcaggccaggggtactgactgccctgatgggtgtcagtggtgctggcaagactactctgatggatgtgttggcagggagaaagacaggtgggtacattcaaggaaacatcagcatttcaggatacccgaagaaacaagagacctttgcacgcgtttcaggatactgcgaacagaacgatatccactctccgcaggtgacagtctatgagtcgctgcttttctcagcatggctccgtctccccgaggatgttgattcaaacaaaagaaggatgttcatcgaggaggtgatggagcttgtggagctcaagcctctgaaagatgcattgattggtctaccgggagtgaatggtctgtcaactgaacagaggaagaggctgaccattgctgtggagctcgttgctaatccttctatcattttcatggatgagccaacctccggacttgatgcccgagcagccgcaatcgtgatgaggacagtgaggaacactgttgatactggtagaactgtggtttgcacgattcatcaacctagcattgacatatttgaagcatttgatgagctattcctgatgaagcgaggtggagaagagatctatgctggtccattgggccatcattctgcagacttaatcaattactacgagggcattcatggagtcaacaaaattaaagatggctacaatccggcaacatggatgttggaagtgacaacgatcggtcaagaacagatgctaggcattgatttcagtgacatatacaagaaatctgaactctaccagagaaacaaggcattgataaaggaactaagccaacccgcgccgggttcaactgatctgtatttccctacccagtactcgcagtcttcgatcacacaatgcatggcttgcctgtggaagcagaacctgtcgtactggaggaaccctccttacaatgccgttaggttccttttcactactgtgattgctctcctcttcggcaccatcttctgggaccttggtggcaaaatgagccagtcacaagacttgttcaacgccatggggtcaatgtatgctgcagtgctgttcatcggtatcatgaactgtacttcggttcaaccagtggtggctgtggagaggacagtattttaccgtgaaagagcagccggcatgtactcagcattcccgtacgcatttggccaggttgtcattgaactcccatacacactcgctcaggctaccgtatacggagtcatagtttactcgatgattgggtttgagtggacagctcctaaattcttctggtacctcttcttcatgtacttcacgctgctctacttcacattctacggcatgatggctgttggcctgacacccaactaccacatcgcctcaatcgtctcgtcagcattctacgccatctggaatctcttctccggtttcatcaccccccgaccaaaagttccaatctggtggagatggtattgctgggtatgccctgtagcgtggacactgtacgggttggttgtctcacagttcggcgatgtcacaacgccgatggatgacggcactcccgtgaaagactttatagagggctacttcgacttcaagcacagctggttaggttatgttgctacggtggtcgtggcgttcgcggtgctctttgccttcttgtttggttttgccatcatgaagctcaacttccagaagaggtagatgatgacgatatgaggcatgttctagaaagaaattgcattagttgcccgcaaatatgaatcgatgtgtacatatcagttgaccacatgggatgttaggttcattagttatcttgtaactagtactccctccatccggaaatactcaaaatgaataaaaggggatgtatctagatgtattttagttctagatagatctattttttgttcattttgatgacaagtattttcggacggagggagtacatcatagaggtatcttttggaaacatttttcaccgtatgaatgc

SEQ ID NO: 260 - DNA, 4860 bp, Oryza sativa
cacgagcccgcggcttgtgactccccccgacccaacccgttccattccgttccgttccaacggaacggattccattcccgcgccccgctacataaaccccccttcgcctcggcgtcgtcgtctccaaggcttccctcccatcccaaaaccagcgcaagcgaggcgaggagtacgtagtggtaggaggtggcacgccgcggcggcggaatcggaatcgactagggagatggatgcggcggcggagatgcagaaggtggtgagcctgaggagagggggaggggggtcgtcgtcgcggggggcggcgtcgatgtggtggagcgcggacaacggggtgttctcgcggtcgagggcgtcgtcgagtggggaggatggggaggacgacgaggaggcgctgcggtgggcggcgctcgagaagctgcccacgtacgaccgcgtgcgccgcgccgtactgccggtggtggaggagggcggcggcggaggggaggcggggaagaaggtggtggacgtgctcagcctcggcccgcaggagcggcgggcgctgctcgagcggctcgtgcgcgtcgccgaggacgacaacgagcgcttccttctcaagctcaaggagcgcatcgaccgggtggggattgatattccgacgatcgaggtgcggttcgagcacctggaggcggaggcggaggtccgcgtcggcaacagcggcctccccaccgtcctcaactccatgaccaacaagctcgagggagccgcgaacgcgctggggattctacccaacaagaagcagaccatgcccatcctccacgacgtcagcggcatcgtcaagccccgcaggatgactctgctgttaggacctcccgggtctggcaagaccaccttgctacttgctttggctggaaggcttggcaaagacatcaagttctctggtcaagtgacttacaatggacaccagatggaggattttgtgccacagaggacagctgcatacatcagccagcatgatcttcatattggggaaatgactgttcgggagacactctcattctcggcacgctgccagggtgttggaagccgctttgatatgctgaccgagctgtcaaggcgagagaaggcagcaaatattaagcctgatgctgatattgatgcgtttatgaaggcttcagcgatggagggacaagagaccaatttgattactgactatatactgaagatattaggactggatatatgtgcagacacgatggtaggagatgatatggtgaggggtatctccggtggacaacggaagcgtgtcaccacaggtgagatgcttgttgggccagccaatgcacttttcatggatgagatatcgactgggctcgacagctcaactacatttcagatcgtgaagtcgctcagacaggccatccacatcctcggtggcacagcagtcatctcgctgttgcagccagctccagagacatatgacctatttgacgacatcatactcctctctgatggtcagattgtataccaggggcctcgagagggtgtgctagaattttttgagttgatggggttcaaatgccctgagaggaagggtgttgcggacttcttacaggaagtaacttccaggaaagaccagaagcagtactggatgcagcatgacaagccctatcggtacgtgccagtcaaggattttgctagtgcattccagtcgttccacactgggaaaagtatagcaaacgaacttgctactccattcgacaagagcaaaaatcatccggctgcattgaccacctcgaggtacggtgtcagtgccatggaactgttgaaggcaaacatcgaccgggagttcttgcttatgaagagaaattccttcgtttatatcttcagagcctgccagctgatggtggtgtcggcaattgcaatgaccgtcttcttccgtacaaagatgcaccgtgattccgtgactgatggagtcatcttcatgggcgcactcttcttctcagtgatgatgataatgttcaatggtctatctgagctaccgctaaccatttttaagttgccagtcttcttcaagcagagagacctcttattctttccagcatggacctacaccataccctcatggatcctcaagatcccaatgtcctttattgaggtcggtgggtttgttttcatgtcatactatgtgattgggtttgatccgagtgcaggaaggttcttcaagcagtatctgcttatgttagcaatcaaccagatggcagcggcactcttcagattcgttggtggggcagcaaggaacatgatcgttgcgaatgtctttggatccttcatgttgctaatctttatggttctgggtggttttattctagtaagagagaaagtgaagaaatggtggatttggggctactggatctccccgatgatgtatgcacagaatgccatctcagtgaatgagtttttggggcacagctgggataaagtcttgaataattctctctccaatgagaccctaggcgtacaagcccttaggtcccgtggcgtcttcccggaagccaagtggtattggattggctttggtgcattgctcggattcatcatgctcttcaatggtctctttactcttgcactaacatacctcaaaccctatggtaagtcccaaccatcagtatctgaagaggagctgaaggagaagcaagccaacatcaatggtaatgttctagacgttgataccatggcatcaagtactaatctagcaatagttgacaacacggaaactagttcagaaattgctgataattctcaacctacacaaaggggtatggttctcccttttgctccgctttcactcactttcgacaacatcaaatactctgtcgacatgccacaggaaatgaaagcgcatggaatagttgaggaccggttggagctcctcaaaggtgtcagtgggtctttcaggccaggagtgctaactgcgcttatgggtgttagtggtgctggaaagactactctgatggatgtgttagcagggagaaagacaggtgggtacattgaaggcaacatcaccatatcaggatacccaaagaaacaagagacatttgcacgtgtatcaggatattgtgaacagaatgacatccactcaccgcaagtaacagtctcagagtcactgcttttctcagcttggctacggcttcccaaggatgtagattcaaacacaagaaagatgttcattgaggaggtgatggagcttgtggagctcaagcctttgagagatgctttagttggtcttcctggagttaatggcctctcaactgagcagaggaagaggttgaccattgccgtagagcttgttgctaatccttcaatcattttcatggatgagccaacttcagggcttgatgcccgagcagctgccattgtgatgaggacagtgaggaatactgtggatactggtagaactgtggtgtgcacaattcatcagcctagtattgacatatttgaagcatttgatgagcttttccttatgaagcgaggaggagaagaaatatatgttggcccgttaggccatcaatcttcagagctgattaagtattttgagggaatcaaaggagtcagcagaattaaagatggctacaatccagccacgtggatgttggaggtgtcaacaatttctcaagaacaggcattaggtgttgatttttgtgacatatacaggaaatctgaactcttccagaggaacaaggcattgatacaggaactgagcacaccaccaccaggttcgagtgaactatatttccctacaaagtactcgctatctttcttaaatcaatgcctagcatgcctgtggaagatgcacctgtcatactggaggaaccctccttacaatgccataagattatttttcactactgtcatagctctcctctttggcaccatcttctgggatcttggcggtaaaacgggcaagtcacaagacttgttcaatgccatggggtccatgtattccgcagtgctttttattggcgtcctaaactctcagtcagttcagccagttgtatcagtggagaggacagtcttttatcgtgaaagagctgctggcatgtattcagctttcccgtatgcatttggacaggttgccatcgaattcccgtatacactggttcagtctatcatatatggcatcatagtgtactcgatgattggttttaaatggacggcggctaaattcttctggtacctcttcttcatgttcttcacgtttctatacttcacattctatggcatgatggctgtgggcctgacaccaagctaccacgtcgcctcaatcgtctcatcggctttctatggcatctggaacctattctccgggttcatcatccccagaccgaaagttccaatctggtggagatggtactgctggatatgccctgtcgcgtggacgctgtacggtctggttgcctcgcagtttggagacattatgacgccaatggatgatggcactcccgtgaaaatcttcgtggagaactacttcgacttcaagcatagctggctgggggtggtggccgtggtgatcgtcgcattcaccatgttatttgccttcctctttggctttgccatcatgaagcttaacttccagaagagatagtgattgatagggtctaggaaacacatcctaaactaggaattacatcaattggtttgcatatacgaaataatttgtgcatatcagtgtagcacatgagaaaaaaaattgaaatgtttgctgtagtgatcttgtaaagttttggtggtatattctcttcctttctttcataattggaatttgtacactaatttgtaaaagatgagttgtgaatggtgcattctttatcagtgagaaatcag

SEQ ID NO: 261 - DNA, 4977 bp, Sorghum bicolor
gaacgtcgcgcgtacccctggccctggcacgggcagcgcaacgcagcgcggagcgcgcgccatgccgctggcctccctggctcccttcccttcccttcccgttaccgctgcctacaaaaacccgccccgtcctctgctctccccaactgcctcggcgtcgtcgcagtcccattccgcgcacacatcagccggaaaacttcgcgaaatccaggccacaccagccacacggggggttccgtctcggctgcgcgggctgcgtcgcggagttgcgggggcggggggcggtgggtagcgccgcggcgggtatggacgcggcggcggagctccagaaggtggcgagcatgcgccgcgacagcggcggctccaggtcgggctcctccgcgtggtggcgcgcgcccgacgcgttctcgcgctcctcctcgcggatggaggaggacgacgaggaggcgctgcggtgggccgcgctcgagaggctgcccacctgcgaccgcgtccgccgcgccatcctcccgctcggcggcaacggagacggccacggccacggcggcggggatgccgccacgcaggtggtggacgtgctcggcctcggcccgcgggagaggcgcgccctcctggagcgcctcgtgcgcgtcgccgacgaggacaacgagcgcttcctgctcaagctcaaggaacgcgtcgaacgggtggggatcgacatgcccacgatcgaggtgcggttcaagcacctaagggcggaggcggacgtgcgcgtcggcaccagcgggctccccaccgtcctcaactccatcaccaacaagctcgaggaggtcgccaacgcgctgcacgtgcgccgcagccgcaagcaggcgatgcctatcctgcacgacgtcagcggcatcgtcaagccccgcagaatgactctgctgttaggtccgcccgggtcagggaaaaccaccttgctgctcgccttggccgggaggctcgacaaagacctcaaggtttcaggcaaagtgacctacaatgggcatgaaatggatgagtttgtgccggagaggacagccgcatatatcagccagcacgaccttcatatcggagagatgactgttagagagacgctagaattctctgcacgttgtcaaggtgttggcactcgctttgatatgttgactgagctttcaaggcgggagaaggtgggaaatatcaagcctgatgctgatatcgatgcattcatgaaggcttgtgcaatgcgaggacaggaagctaatgtgatctctgactatatattgaagatattaggattagaaatatgtgctgacacgatggtgggagatgacatgttgaggggcatctctggtggacaacggaagcgtgtcacaacaggagagatgcttgttggtccggccaatgcactattcatggatgaaatttcgactgggcttgacagctccactacgttccagattataaagtcgcttagacaggcaatccacatcctcggtggcacagctctcatctccttgttacagcctgcacccgagacatatgatctttttgatgacatcatactcctctcggacgggcagattgtgtatcaggggccccgagaaagcgtgcttgaattcttcttgtctcttgggttcaagtgtcctgagaggaagggtgtggctgactttttgcaagaagtgacttctaggaaagatcaaaagcaatactgggtgtggcatgacaagccataccgatatgtttcggttaaggaatttgcaactgcattccagtgtttccatgttgggagagccattgcaaatgagctagccattcctttcgacaaaagcaaaaaccatcctgctgctctgaccacctcaaagtatggtgtcagtgcctgggagctgtttaaagcaaacatcgatcgagaaatgttgcttatgaagaggaattcctttgtctacatcttcagaactttgcagttgatgacggtgtccataattgcaatgactctcttctttcgtaccaagatgcaccgtgactcggtgactgatggtggtatctacttgggagcactcttctttgcagtgatcatgatcatgttcaatggattgtctgagcttgcactcaccatcattaagctaccagtgttcttcaagcagagagatctcctcttctttccggcatgggcctacacaatacccacatggatcctcaagatcccaatatcttttgttgaggttggtgggtttgttttcatggcatactatgtcatcgggattgacccaaatgtaggcaggttcttcaaacaatatctccttttgttagcactcaatcagatggcagcatcactattccgatttgttggtggggcagcaaggaacatgattgttgcaaatgtctttggatcattcatgctactaatatttatggtgttgggtggatttatcctagtaagagataaagtgaagaagtggtggatatggggctactggatctccccattgatgtatgcgcagaatgctatctccgtaaatgagatgctagggcacagctgggacaaaattttgaatagctccgtgtcttatgagaccctaggtgtgcaatcccttaagtcccgtggagtcttcccagaagcaaagtggtattggatcggcttaggcgcattgcttggatttgtcatgctcttcaattgtctctttacgcttgccctagcgtacctgaagccatatggcaagtcccatccatcgatatctgaagaagaactgaatgagaagtatgcaaacctcaatggtaatgttgtggctgaagataacttgccaccaggaagtagctatctagcagcagtcgacatcactagatccgattcagcaactattgaaaatcattctggtactatgcaaaggggtatggttcttccatttgccccactttcactgacttttagtaacatcaagtactttgttgacatgccccaggagatgaaaacacatgatgtagtcggggaccggttagagctcctcaaatgtgttagtggatcttttagaccaggagtgctgaccgcactgatgggcgttagtggtgctggcaagacaactctaatggatgtgttggctgggagaaagaccagtggttacattgaaggaaatattagcatttcaggatacccaaagaaacaagagacctttgcacgtgtatcaggatattgtgagcaaaatgatatccactcgccacaggtgacagtctatgagtcacttgttttctcagcgtggctccgccttcctagtgatgtagatttaaacaccagaaagatgttcattgaggaggtcatggagcttgtggagctcaagccattgagaaatgctttggttggtcttcctggtgtgaatggtctgtcaactgagcagaggaaaagattgaccattgctgtggagctggttgcaaatccctcaatcattttcatggatgagccaacctctggtcttgatgcccgagcagctgcaattgttatgagaacagtgaggaatactgttgatacaggtagaactgtagtctgcacgattcatcagcctagcattgacatatttgaagccttcgatgagctttttcttatgaagcgaggaggagaggagatctatgttggtccactaggccatcattcttccgagctgattaagtattttgagggaattcacggagtcaagaaaattaaagatggctacaatccagcaacatggatgttagaagtaacaacaatctcacaagaagagatactaggtgttgattttagtgacctgtacaagaaatctgaattatatcagaggaacaaggccttgatacaagagttaagcgaaccatcagtaggctcaactgaccttcatttccgtaaccagtactctcagtctttcttcatgcaatgccttgcttgcttgtggaagcagaacttgtcatattggaggaaccctgcttataatgctgttaggctatttttcacaactatcatagcacttatctttggcaccatcttctgggaccttggtggtaaaatgggtcaatcacaagatttattcaacgccatggggtccatgtatgctgcagtgatgttcattggtgtcttgaatgctacatctgtccagccagtagtctcagtggagcgaactgtgttttaccgtgaaagagctgctggcatgtactcagctctgccatatgcatttggacaggttaccattgaactcccatacactctgactcaggccaccgtatacgggatcatagtgtactcgatgattgggtttgaatggacagttgccaaattcttctggtacctcttcttcatgtacttcacctttctctatttcacattctatggcatgatggctgtgggcttgacgccgagctaccatgtcgcgtctatcgtctcctcggcattctatggcatttggaacctcttctctggattcattatccctcggccgaaagtcccaatatggtggaagtggtactgttgggcgtgccctgtggcgtggacgttgtatgggcttgttgtgtctcaattcggggacatcacgatgcccatggacaatggtgtccccgtgaatgtgttcgtggagaactacttcggcttcaagcacagctggttgggcgtggtggccgcggtggtcatggcgttcaccatcttctttgcttccttgtttggctttgccatcatgaagctcaacttccagaggaggtagcaatgtatagcaactacacgaaattaacatgccctgctggtagatagaagtttgacaacatcattgtttctgtcctattcagtacaacatacgaaatgtttgaccttgttagtgtccctgcaatgtaaagctaaagtgttgtgatttcattttattttgattttattgtattatgtctatgtaagggtcgtgtaattttgtaatggatgttgtacatataattttgctatcttatgcagggaggcttacgttaaagcttgcttagcaagcattcctattt

SEQ ID NO: 262 - DNA, 4539 bp, Setaria italica
cacggtagtagacgtctagacgagcaggcgatggacctggccggcgaaatccagagggtggtgagcatgcggcgggacagcggtggctccgtgtggcggagcaggaacgacgcgttctcgcgctcgtcgagggaggcggatcgcgtcgacgacgaggaggcgctgcgctgggcggcgctggagaagctgcccacgcgcgaccgcgtgcggcgcgccatcctcgtcccccctggagacgacgaggggcagggggtcatggacgtggacgtgctcagcctcggccccggcgagcggcgcgcgctgctggagcgcctcgtgcgcgtcgccgacgaggaccacgagcgcttcctcgtcaagctcagagagcgcctcgagagggttgggatcgacatgccgacgatcgaggtgcggttcgagcacctggacgtggaggcggaggtgcgcgtcggcagcagcggcctccccaccgtcgtcaactccatcaccaacacgatcgaggaggcggccaccgcgctgcgtctgctgcgcagcaggaagcggaagatgcccgtcctccacgacgtcagcggcatcatcaagccccgcaggatgactttgctgttaggcccgcccgggtcaggcaagaccaccttgctgctcgcgttggccggaaggctcgacaaggacctcagggtttcaggcagggtgacctacaacggccacggcatggaggagtttgtgcccgagcggacggccgcctacatcagccagcatgacctccacatcgcggagatgacagtgagggagacgctcgccttctccgcacgctgccagggtgtgggctcccgctttgatatgcttatggagctgtcgaggcgagagaaggccgcgaatatcaagcctgatgctgacatcgatgctttcatgaaggcgtctgcagtgggaggacatgaggccaatgtggtcactgactatattctcaagatactggggctagagttatgtgcagacacaatggtaggggacgagttgctcaggggcatctccgggggacaacgaaagcgtgttacgaccggtgagatgctggtcgggccagccagggcgcttttcatggacgagatctccactggccttgacagctccaccacgtttcagatcgtgaactctctcaggcagtccatccatgtcctcggtggcacagccgtcatctccctgctgcagccagcgcctgagacttacaacttgttcgacgacatcatccttctctctgatggccaggtcgtgtaccaaggtccccgggaggacgtggttggattcttcgagtctatggggttcagatgccatgagaggaagggtgtagcggacttcttgcaagaagtgacttcaaggaaagatcagaaacagtactgggcagaaccagacaagccctacaggtttgttccggccaaggaattcgcgactgctttcaagtccttccacaccggtatggctctagcaaaggagctatccgtgacgttcgacaagagcaagagccatccggctgcactgaccaccacgaggtacggcgtgagtgccaaggcgttgctcaaggccaacatagaccgggagatacttctcatgaagaggaactctttcatttacatgttcagaacattccagttgacactaatgtcactcatcgcaatgaccgtcttctttcgcaccaagatgaagcgtgactctgtgacaagtgggggcatcttcatgggggctatgttctttggcatccttatgatcatgtacaacggattctctgaacttgcactcactgtcctcaggctgcctgtattcttcaagcagagggacctcctcttctatccagcatggtcgtacactgtaccctcatggatccttaagttccccgtaaccttgatggaggtttccggatatgttttcgtaacatactatgtcatcgggtacgacccaaatgtaggaaggttcttcaaacattatctgataatgctggcaattaaccaagtggcagcatcactctttcgtttaatcggcggggcagcaaggaacatgatcatagcaaatgtctttgcaatgctcattatgatgactttcatggtcgtaaacggtttcattctagtaagagatgacgtgaagaaatggtggatctggggctactggatatccccgctgatgtatgtgcagaatgccatcacagtgaatgagtttttggggcatagctgggataaaattttgaatagcactgtctccaacgagactctcggtgtgcaagtccttaagtcccatggggtgttcccggaagccaggtggtattggataggctttggtgcattgctcggattcaccgcgttgttcaatgttctcttcactcttgcccttacatgtcttaggccatatggaaaccccaggccatcagtatctgaagaggtgctgaagcagaagcaatccaatgtgaaaaatgggattcctgatgccaccccttgggcgtctgttcaaccaataggggataacacggaaactaatttagagatgtcggaagatgattgtggccctactcagaaggggatggttctcccatttctcccactttctctcagctttgatgacattcgatactctgttgatatgccacaggaaatgaaagcgcaaggtgtagctgatgaccgcttggcactcctcaaaggtgttagtgggtcttttaggccaggggtgttgaccgccctgatgggtgtcagtggcgcaggaaagactacgttgatggatgttttagcagggagaaagactggtggctacattgaaggaaatataagcatttcaggatacctaaagaatcaagaaacatttgctcgtgtaactggatattgtgaacagaatgatatccactcaccccaactgactgttcgtgagtcattgcttttctctgcatggctccgccttcctaaggatgtggattcgaatacaagaaagatgttcattgaggaggtgatggagcttgtagagcttaaaccactgagagatgctttcattggacttcctggaataaatggtttgtcaaccgagcagcggaagaggttgacaattgctgttgagcttgttgcgaatccatccatcatcttcatggatgagccaacatcagggcttgatgcacgggcagcggcaattgtgatgaggacagttaggaacactgttgatactggaagaactgtggtctgcaccatacatcagcctagtattgacatatttgaagcatttgatgagcttttttttatgaagccaggtggagaagagatctatgtgggtccactgggtcataattcttctgagctgatcaagtacttccaagggattcaaggtgtcagcaaaattaaagatggttacaatccagcaacatggatgctggaagtaacaacagtctcccaagaacagatattaggcgttgattttagtgacatacacaggaaatccgaactctaccagaggaacaaggccttgataaaggaactgagccagccggcaccaggttcgagcgacctgtatttccctaccaagtactcgcagccttccttcacgcagtgcatggcctgcctgtggaaacaaaacctgtcctactggaggaaccctccttacaacgccgtcaggatcatcttctctacagttactgcgcttcttttcggcaccgtgttctgggaccttgggggcaaagtgaagcggcaacaggatttgattaacgccttggggtcaatgtatgctgcggtgctgttccttggtgtctcgaattccatctctgttcagccggtggtggcagttgagaggacagtcttctaccgcgagagagccgccggcatgtactcatttttcccatacgcatttggacaggtcgtcatcgagctcccgtatgcgttggttcaggccaccgtgtacggggtcatagtgtacgcgatgatcgggttcgagtggacggccgccaagttcttctggtacctcttcttcatgtacttcacgctgctctacttcaccttctacggcatgatgtgcgtcggcctcacgcccaactacaacatcgcctccatcgtctccacggcgttctacaacatctggaacctcttctcagggttctttatcccccgcccaagaacgccgatctggtggagatggtactgctgggtatgccccatcgcgtggacgctgtatggactcgtcgtctcgcagtacggcgacatcaccacgcctatggaggatggcaggcctgtcaaggtgttcctggaggactacttcgacttcaagcacagctggttggggtgggcggccgccgtcgtcgtggctttcagtgtgctcttcgctgcattgttcgccttcgccatcatgaagctcaacttccagaaaagatgacgctatatatatagatataccagttcgggagattacgatcgagggcgaatgaaacgagcgacttcgaaaaatttcggatttcaaatttcgagttactattcacagcactattcaaattcggccaacactattcaaattcacggcactatttaaattcag

SEQ ID NO: 263 - DNA, 4946 bp, Sorghum bicolor
tatatatactaggcagctaggctttgctctcgctaacttaacaggcctgcctatatctataccaccacatcgatcatcagactacatacatctggccgtgggcgccggcgatggacccgtcaggggagatccggaaagtggctagcatgcggcgggacagtggcggctccgtgtggcggagcggcggaaacgacatcttctcgcgctcgtcgagaagagacgacgacatggacgacgaggaggcactgcgctgggccacgctagagaaacttcccacacgcgaccgcgtacgccgtgccatcattttcccgctcccaccagctggcgcggcggggacgacgacggggcagcagcaggggctcgtcgacgtggacgtgctcagcctcggccccggcgagcggcgtgcgctgctggagcggctcgtgcgcgtcgccgacgaggaccacgagcgcttccttgtgaagctcagagagcgcctggacagggttgggatcgacatgccgacgatcgaagtgcgtttcgagcacctgaacgtggaggcggaggtgcgcgtcggcagcagcggcataccgaccgtcctcaactccatcaccaacacgctggaggaagcagccactgcgctgcgcatactgcgcagcagaaagcgggcgttgcccatcctccacgacgtgagtggcatcatcaggcctcgcaggatgactttgctgttaggcccacctggatcgggcaagaccaccttgctgttggcgctggccggaaggcttgacaaagacctcaaggtttctggcagagtgtcctacaacgggcatggcatggaggaatttgtgcctcagaggacggccgcgtacatcagccaacatgacctccatatcgcagagatgacagtgagggagacgctcgccttctccgcacgctgccagggtgttggctcccgctttgatatgcttatggagctgtcgaggcgagagaaggcggctaatattaagcctgatgctgatatcgatgcattcatgaaggcgtctgcagtgggaggccacgaggccaatgtggtcactgactatattctcaagatactaggactagagttgtgtgcagacacaatggttggagatgagatgctcaggggcatatccggaggacagcgaaagcgtgttacaactggtgagatgctggtcgggccagccagggcacttttcatggatgaaatctccactgggcttgatacctccactacgttccagattgtgaactcgctcaggcaatcaatccatgtccttggtggcacagccgttatctcccttctgcagccgggccctgagacgttcaacttattcgatgatatcatcctgctgtcagatggccaagttgtgtaccaaggtccccgagaggatgtgatcgaattctttgagtctatggggttcagatgccctcagaggaagggtgtagctgacttcttgcaagaagtgacttcaaagaaagatcagaaacagtactgggcatggtcagacaagccctataggtttgttccagccaaggaattcgcaactgctcacaagttattccacactgggagagctttagccaaggatctcgccatgccattcaacaagaacaagagccatccagctgcactgaccaccaccaggtacggtgtgagtggcatggagttgctgaaggcgaacatagacagggagatccttctcatgaagaggaattctttcatttacgtgttcagaacattccagttgacactaatgtcaatcatcgcaatgactgtattcttccgtacaaacatgaagcatgattccgtggcaagtgggggcatttacatgggcgctatgttctttggtatccttatgatcatgtacaacggcttctctgagcttgcgctcactgtcttcaggctacctgttttcttcaaacagagagaccttcttttctatccagcatgggcgtacacaataccctcatggatccttaagatcccaatcagctttatggaggtttctggatatgttttcttaacatactatgtcattgggtatgacccaaatgtaggaaggttcttcaaacagtatctcataatgttggcaattaaccaattggcagcgtcactctttcgatttattggaggggcagcaaggaacatgatcgttgcaaatgtctttgcaatgcttgttatgatggctgccataatcttaaacggtttcattataataagagataaagtgaagaaatggtggatatggggctactggatctccccactgatgtatgtgcagaatgccatcacagtaaatgagatgttgggccatagctgggacaaagtattgaatagaactatttccaatgagactttgggtgtgcaggttcttaagtcccatggggtgttcccggaagccaagtggtattggataggctttggtgcattgctgggattcacaattttgctcaatgttgtcttcacttttgcccttacatatcttaagccaaatggaaaccccaagccatcaatatcggaagaggagctgaagctaaagtgttccaatgtaaataatgacattatggatgccaatcccttggcatctagaactactcttcagctaataggaaacaacactgaaactaatttagaaatgttggaagataattctggccctagtcaaagggggatggttctcccatttcccccactttctctcagctttgatgacattcgatactccgtcgatatgccacaggaaatgaaagcacaaggtgtagttgaagaccgcttgatactccttaaaggcattagtggatcttttaggccaggggtgttgaccgcactgatgggtgtcagtggagccggaaagactacgttgatggatgtattagcagggagaaagactggcggctatgtcgaaggaaatataagcatttcaggatatttgaagaatcaagagacattcgctcgtgtatctggatactgtgaacagaatgatatccactcacctcaagtgacagttgatgagtcattgcttttctctgcttggctccgtcttcctaaggatgtagattccaacacaagaaagatgttcattgaggaggtcatggaacttgtagagctgaaaccactgagagatgctttggttggacttcctggagtaaatggtttgtcaaccgagcagcgtaagagactgacaattgctgtggaacttgttgcaaatccatccatcatcttcatggatgagccaacctcagggctcgatgcacgggcagcagcaattgtgatgaggacagttaggaacactgttaatactggtagaactgtggtttgcacgatccatcagcctagcattgacatatttgaacaatttgatgagctttttctaatgaagcggggtggagaagtgatctatgctggtccattaggtcacaactccttggagctgatcaagtatttcgaggcgattgaaggtgtcagcaaaattaaagatggctacaatccagcaacatggatgctagaagtaacaacagtctctcaagaacatgtcttaggtgttgattttagtgacatatacaagaaatccgagctctaccagaggaacaaggatttgataaaggaactaagccaaccggcaccaggttccagagacctatattttcccactaagtactctcagtcttctttcactcaatgtatggcttgtatttggaaacaaaacatgtcatactggaggaaccctccttacaacactgccaggtttattttcactactattacggcccttatttttggcaccatgttctggaaccttggtagcaaaatagacaagtcacaggacttgttcaacgccttgggatccatgtatctttcggtgatattccttggttgcacaaattctatctctgttcagccagttgtggccgttgagcgaacagtgttttaccgtgaaagagcagccggcatgtactcagcattcccttacgcatttggccaggttgtaatcgagctcccatatgctttagttcaagcttccatatatggggtaatagtgtatgcaatgattggatttgagtggactgctgccaaattcttctggtacctcttcttcatgtacttcacactgctctacttcacattttacggcatgatgggagttggcctcacgccaaattaccagatagcctccattgtctctacggcattctacaacatctggaacctcttctcggggttctttattcctcgccctaaaacaccaatttggtggagatggtactgttggatatgccctgtcgcgtggacattatatgggcttgttgtttcgcaatatggtgacatcaccacacccatggaagatggcaggactgtgaatgtattcctagaggactactttgacttcaagcacagttggctaggccgggccgctgccattgttgtggcttttagcgtattctttgccaccttgttcgcctttgccaccatgaagctcaactttgagaaacgatgacgatgataagaactggacagcaccacatagagctgcaaaacaaatgatgtttggtgtattgcaaaacaatggattctgtgtatgaatgaatcatatgtgtactattctatatatataatatttctatcctgacactactacacaaacatcttcaccatcactttgaaacccccatcatcactggatttgacactcggtggtgatatattgttagtgatggcccacctcatcaccaccgatttataactagcggcactgttggtttggcgtatgatgcaactatgatcgtctagtcgtagtcgcataggttggttccagcagtgatggcatttggtcaccaccaatcagtatgcgaactcggtggtgatatgtaatacatcaccaccgtttatttgtttcatcaagcgttgatgagtacttgatcaatgttgtccttttgtttgaatcggc

SEQ ID NO: 264 - DNA, 4771 bp, Panicum virgatum
gcgtcctcgtcgcaccccgcggaaacgccctgcggcagagacgtctcgaccgggctgctcagggagggcttagctagcagagagttggcaggcgtgggtgcgggtagcgccgcggcgggggcaatggacgcggcggcggagatccagaaggtggcgagcatgcgcctggacagcggcggctcccggtcccggtccgggtccgggtcctccgcgtggtggcgcgcgcccgccgacgccttctcgggctccctgtcgcggagggggggcgacgaggacgacgaggaggcgctgcggtgggccgcgctcgagcggctgcccacctgcgaccgcgtccgccgcgccatcctcccgctcgccgccgagggcgccgaggcgggcgcgcaccaggtggtggacgtgctcagcctcggcccgcacgagcgccgcgcgctgctggagcgcctcgtgcgcgtcgccgacgaggacaacgagcgcttcctgctcaagctcaaggaccgcgtcgagcgggtcgggatcgacatgcccacgatcgaggtgcgcttcgagcacctcaaggcggaggcggaggtgcgcgtcggcaccagcggcctccccaccgtcctcaactccatcaccaacaagctcgaggaggtcgccagcgcgctgcgcgtgcgccgcagccggaagcaggcgatgcccatcctccacgacatcagcggcatcgtcaagccccgcagaatgaccctgctgctaggcccgcccgggtcaggcaaaaccaccttgctgctcgccttggccgggaggctcgataaagacctcaaggtgtcaggcaaagtgacctacaatgggcatgggatggacgagtttgtgccggagaggacagcggcgtacatcagccagcatgaccttcacattggggagatgactgtcagggagacgcttgaattctccgcacgctgtcaaggtgttgggagtcgctttgatatgctgactgagctttcaaggcgggagaaggtgggaaacatcaagcccgatgccgatatcgacgcattcatgaaggcttgcgcaatgcggggacaggaggctaatgtgatttctgattatatactgaagatattaggattagaagtatgcgcagacacgatggtgggggatgagatgttgaggggcatttctggtggtcaacggaagcgcgtcacaacaggtgagatgcttgttggtccagcgaatgcgctgttcatggatgaaatttcgactgggcttgacagctcgactacattccagatcataaagtcacttaggcaggctatccacatcctcggtggcacagccctcatctccttgctgcaacctgcacccgagacatatgacctttttgatgacatcatactgctctcggacgggcagattgtgtatcaggggccccgagaaagcgtgctcgaattcttcttgtctcttgggttcaagtgtcctgagaggaagggcgcggctgactttttgcaagaagtgacttctaggaaagatcagaagcagtactgggcacggcatgacaaaccataccaatacgtgtcggttaaggaatttgcatgcgcattccagtctttccatgctgggagagctgtagcaaacgagctagccattccttttgataagaggaagaaccatcctgctgctctgaccacctcgaggtatggtgccagtgccagggagctgttgaaagcaaccatcgaccgggaaatcttgcttatgaagaggaattccttcgtctacatcttcagaactttgcagatgatgatggtgtccacaatagcaatgactctcttcttccgaacaaagatgcaccgagactcagtgactgatgggggtatctacctgggctcacttttctttgcggtgatggtgatcatgttcaatggattatctgagcttgcactcaccatcattaagctgccagtattcttcaagcagagagatctcctattctttccagcatgggcctacaccatacccacatgggtcctcaagatcccaatctcttttgttgaggttggtgggtttgttttcatggcatactatgtcattgggtttgatccaaatgtaggcaggttcttcaagcagtatctccttttgttagcagtcaaccaaatggcagcatcactcttccgatttgttggtggggcagcaaggaacatgattgttgcaaacgtctttggatcatttatgctgctaatctttatggtgttgggtggatatattctagtaagagataaagtgaagaagtggtggaaatggggctactggatctccccgttgatgtatgcccagaatgccatatcagtaaatgagatgttggggcacagctgggacaaaattttgaatagctctgtctcaaatgagactctaggtgtgcaatccctcgagtcccgtggagtcttcccagaagcaaagtggtactggatcggcttaggcgcattgcttggatttgtaatgctcttcaattatctcttcactcttgcactggcatacctgaagccatatggtaagtcccatccctcaatatctgaagaggaactgaaggagaagtatgcaaacctcaacggaaatgctctggctgaagatagcttggcactaggaagtacccatcgagcaatagttagcatcactggatctggttcggcaactgctgaaaatcattcttgcactacacaaaggggtatggtccttccatttgcgccgctttcgctcactttcaacaatatcaagtactttgttgacatgccacaggaaatgaaaacacatggtgttgtcgaggaccggttagagctcctcaaaggtgtcagcggatctttcagaccaggagtgctgaccgcactgatgggtgtcagtggtgctggcaagacaactctaatggatgtgttggctggtagaaagacaagtggttacattgaaggaaacatcagcatttcaggatacccaaagaaacaagagacctttgcacgtgtatcaggatattgtgaacagaacgatatccactcgccacaggtgacagtctatgagtcgcttcttttctcagcatggctccgccttcctatggatgtagattcaaacactagaaagatgttcattgaggaggttatggagcttgtggagctaaagccattgagaaatgctttggtgggacttcctggtgtgaatggtctgtcaactgagcagaggaaacggctgaccattgctgtagagctggttgcaaatccctcaatcattttcatggatgagccaacctctggccttgatgcccgggcagctgcaattgttatgaggactgtgaggaatactgttgatacaggtagaactgtggtctgcacaattcatcagcctagcattgacatatttgaagcctttgatgagcttttccttatgaagcgaggaggagaagagatctatgttggtccattaggccatcattcttctgagctgattaagtattttgagggaattcaaggagtcaggaaaattaaagatggctacaatccagcaacatggatgttagaagtaactacagtctctcaagaacagatactaggtgttgatttttgtgacctatacaagaaatctgagctctaccagaggaacaaggccttgatacaagagttgagcgaaccccaagcaggttcaagtgaccttcatttcagtgaccggtactcgcaatcttttttcatgcaatgcttggcttgcctgtggaagcagaacctgtcatattggaggaaccctgcttacaatgccgttaggctattttttactaccatcatagcccttatctttggcaccgtcttctgggaccttggtggtaaaatggggcaatctcaagatttgttcaacgccatggggtccatgtatgctgcagtgatgttcctcggcgtcttgaacgctacatctgttcagccggtggtatccgtggagcggacagtgttttaccgtgaaagagctgccggcatgtactcggctttaccatacgcatttggacaggttaccattgaactcccatacaccctggcccaggccaccgtatacgggatcatagtgtactcgatgatcgggttcgaatggacggcgaccaagttcttctggtacctcttcttcatgtatttcaccttcctctacttcactttctacggcatgatggccgtgggcctgacgccgagctaccacatcgcctccatcgtctcctccgcgttctacggcatctggaacctcttctctgggttcatcatcccacgaccgaaagtgccgatctggtggaagtggtactgctgggcgtgccccgtggcgtggacgctgtatgggctgatcgtgtcgcagttcggcgacatcacgacgccgatggatgacggcgtccccgtgaaggtcttcgtggagaactacttcggcttcaagcacagctggctgggcctggtggccgcgatggtcgtggtgttcgcggtgttcttcgccttcctgttcggcttcgccatcatgaagctcaacttccagaggaggtagtatgaagctcaacttccagaggaggtagtgacggtacatatatgtatatggggggactacgaaattaatcaaacctgccccgcgagtagaattgcgtctgttatttgtttgcgagtacgtaatgatttgtttgatttgattaggttcgtgtatactgttttgtaaccgggtgtgtgtatatcatgtatacagacacagaaatgcaagagaatctttgatgagggaccaaatttcagagaatgttattgttagc

SEQ ID NO: 265 - DNA, 4716 bp, Sorghum bicolor
gcgtgcgtgcgtagcgccgcggcgggtagtatgaacgcggcggcggagctccagaaggtggcaacaagcatgcgcggcaacagcggcgggtccgggtcgggccgcccctccgcgtggtggcgcgcgcccgacgacgcgttctcgcgctcctcttcgcggagggaggaggaggacgacgaggaggcgctgcggtgggctgcgctcgagaggctgcctacctgtgaccgcatccaccgcgccatcctcccgctcggcggcggcgactgcgacggcggcggggaggcggccccgcaggtggtggacgtgctcggcctcggcccgcgcgagaggcgcgcgctcctggagcgcctcgtgcgcgtcgccgacgaggacaacgagcggttcctgctcaagatcaaggaacgcgtcgaacgggtcgggatcgacatgcccacgatcgaggtgcggttcgagcacctaagcgcggaggcggacgtgcgcgtcggctccagcggactccccaccgtcctcaactccatcaccaacaagctcgaggacgtcgccaacgcgctgcacgtgcgccgcagccggaagcaggcgattcctatcctgcacgacgtcagcggcatcgtcaagccccgcagaatgactctgctgttaggtccgcccaggtcagggaaaacaaccttgctgctcgccttggccgggaggctcgataaagacctcaaggtttcaggcaaagtgacctacaatgggcatgaaatggatgagtttgtgccggagaggacagccgcgtatatcagccagcatgaccttcacattggagagatgactgttagagagacgcttgaattctctgcacgttgtcaaggtgttggcactcgcttcgatttgttggctgagctttcaaggcgggagaaggcaggaaatatcaagcctgataccgatatcgatgcattcatgaaggcttgttcaatgcgaggacaggaagcaaatgtgatctgtgactatatactgaagatattaggattagaaatatgtgctgacacgatggtgggagatgagatgtggaggggcatctctggtggacaacggaagcgtgtcacaacaggcgagatgcttgttggtccggccaatgcactgttcatggatgaaatttcgactgggcttgacagctccactacattccagatcattaagtcacttagacaggcaatccacaacctcggtggcacagctctcatctccttgctacagcctgcgcccgagacatatgatctttttgacgatatcatactgctctcggatgggcagattgtgtatcagggcccccgagaaagcgtgctcgaattcttctcgtctcttgggttcaagtgtcctgagaggaagggtgtggctgactttttgcaagaagtgacgtccaggaaagatcaaaagcaatactgggtgcggcatgacaagccgtaccaatacgtgtcagttaaggattttgcatctgcattccagtctttccatgttgggagagctatagcaaatgagctagttgttcctttcgacaagtgcaaaaaccatccctcttctctgaccacctcaagatatggtgttagtagctgggagctgttgaaagcaaacattgaccgagaaatcttgcttatgaagaggaattcctttgtctacatcttcaaaactttgcagctgatgatgatgtccataatgggaatgactatcttctttcgtaataagatgcaccatgactcagtgactgatggtggtatctacttcggtgcgctcttctttacggtgatcacaatcatgttcaatggattttctgagcttgcactcactgtcattaagctgccagtgttcttcaagcaaagagatctcctcttctttccagcatgggcctgcaccatacccacatggatccttaggatcccaatctcttttgttgaggttggtgggtttgttttcatggcatactatgtcattgggtttgacccaaatgtaggcaggttcttcaagcagtatcttcttttgttagcattcaatcagatggcaacatcactcttccgattcgttggtggggcagcaaggaacatgattattgcaaacgtctttggaggattcatcctgctaagctttatggtgttgggtggatttattctagtaagagacaaagtgaagaagtggtggatatggggctattggatctccccactgatgtatgcccagaatgccatctcagtaaatgagatgctagggcatagttgggacaaaattttgaatagctctatgtccaatgaaaccctaggtgtgcaatccttgaagtcccgtggagtcttcccagaagcaaagtggtattggatcggcttaggtgcattgattggatttgtcatgcttttcaattgtctcttcacacttgccctagcctacctgaagccatatgggaagtcccatccatcgatatctgaagaggaactgaaggtgaagtatgcaaacctcagtggtaatgttgtggctgggggcaacttgccactaggaagtagccatttagaaacagttggcatcactagatccggttcagcaactgttgaaaatcattctggcactacgcaaaggggtatggttcttccgtttgcccggctttcactaactttcaataacatcaagtactttgttgacatgccccaggagatgaaaacacttggagtagtcggagaccggttagagctcctcaaaggtatcagtggatctttcaaaccaggagtgctgaccgcactgatgggtgctagtggtgctggcaagacaacactaatggatgtactggctgggagaaagaccagtggttacattgaaggaaacattagcatttctggatacccaaagaagcaagagacctttgcacgtgtatcaggatactgtgagcagaatgatatccactcgccgcaggtgacagtctatgagtcacttgttttctcagcatggctccgccttcctaaagatgtagattcaaacaccagaaaggtgttcattgaggaggtcatggagcttgtggagctcaaaccattgagaaatgctttggttggacttcctggtgtgaatggtctgtcaactgaacagaggaaaagattgaccattgctgtggagctggttgcaaatccatcaatcattttcatggatgagccaacctctggtcttgatgcccgagcagctgcaattgttatgaggacagtgaggaatactgttgatacaggtagaactatagtctgcacgattcatcagcctagcattgatatatttgaagcattcgatgagcttttccttatgaagccaggaggagaggagatctatgttggtccactaggccatcattcttctgagctgattaagtattttgagggaattgacggagtcaagaaaattaaaaatggctacaatcctgcgacatggatgttggaagtaacgacaatctcgcaagaacagatactaggtgttgactttagtgacatgtacaagaaatctgaattataccagaggaacaaggccttgatacaaaagttaagcgaaccatcagcaggctcaagtgaccttcatttccgtaaccaatactcgcagtctttcttcatgcaatgcgtggcttgcttgtggaagcaaaacctgtcatattggaggaaccctgcttacaatgccattaggctatttttcacaactatcatagcgcttatctccggcactgtcttctgggaccttggtggtaaaatgagccaatcacaagatttgctcaacaccatggggtccatgtatgctgcagtgatgttcattggcatcttgaatgctaaatctatccagccagtagtctttgtggagcggactgtgttttaccgtgaaagagctgccggcatgtactcggctttgccatatgcatttggacaggtttcgattgaactcccatacactctggctcaggccaccatatatggggtcatagtgtactcgatgatcgggttcaaatggacagttgccaaattcttttggtacctcttcttcatgtacttcaccttcctctacttcacgttctatggcatgatggctgtgggcttgacaccgagctaccctgtcgcgtcaatcgtctcctcggcattctataacatctggaacctcttctctggattcatcatccctcgccccaaagtccccatctggtggaattggtactgttgggcatgccctgtggcatggacgctgtatgggctggttgtgtctcagtttggggacatcacgacacccatggacaacggtgtccccgtgaatgtgttcgtggagaagtacttcggcttcaagcacagctggttgggcgtggtggccgtggtggtcgtggcattcgccatcttctttgctctcctattcggcttcgccatcatgaagctcaatcaccagaggaggtagcgatgtgtagcaactaagcgaaattaattaacatgccccgctggtagaagtccatcacttgctttgcaaacaatacatcactatttctgtcgtattcagtgcaacatacgaaatgtttgaccttgttagcggccctgcaatgtaaagctaaagcatcgagatttcatttgattttaattttattttattatggccttgtttagtttgcaatttttttggtttttggctactctagcacttttatttttatttgacaaacattgtctaattacagagtaactaggctcaaaa

SEQ ID NO: 266 - DNA, 1508 bp, Zea mays
cacacaggagaaaattaattacaatactcgatcggaccggaacaaaacccgcatgtgcgccaattactccctccccaatcccagaaaaaacaccgcagattcccggaacctgcagcacgggccgggccaatccaccgccgcaggccgcagcagcactgaatctgctctcatctcagacagcaacaaaaagttgccacctcccctggaaaagggaaaaaagaaacaatctttgcggcgccagcgggcgcgcgcagcctatataaagctagcgcgggcaaatcccctcactccacaagtccagagacccggccagctgctttagtttgattccaattccaaccaacaaccatcagcagacagcagcttattaatttgattcggacatcgatcggttcatgctagctctgcggacggccgcgcgcacgtacgtacgtacgttcaacggatagctagctagctagctagctgagagaccatggacagcaagctgggcgtgcagcacgggcaccgccaccaccacagccacaacggcgtctccaagccgccggtcgcaaggaggaggcagagcggcggcggcggcggcaagggggtcaaggtggtgtacatctccagccccatgaagctcaccgccagcgccgaggagttccgggccatcgtgcaggagctcaccggccgcgactccaacgtcgccgaccacgacctcgacggcggcggcgcctaccacgtgggcgcgccgtcgtcgtcctcgtcctcgtcgtcttcctactcctccctcggacgcgtctccccggccgtggcggaggcggcggccgccgcagcggcgggagcccgcgctcggtcgtcgccggcgaccaacgccgggggggcgccgccggtggtcgagtacgccgccgcgatggcccagccgccgccgttccagttccagttccagggcatgtacgaccaccagactgccgggagcttgctttacggcctggacaactggtaggaacatatcgtatgctggacgggattagtttgtcttcggctgcgatttgattgtttcacatgcgacgcctatgaggaggacacatgtcgaccacgtcgtgtatattatatctgtagcgtgtattcacatacggtttttgtatgtgcgtgcatggttcttcttctttaggctgcaccatccatcatcttgtacttgatatgaacagtgtgttaatagtggctagatgtatctatcagtacatgtttttgccccgttttctctgtaatacttgattctgacatccaaaatcaacggatacgcgtgctagctgctgccaagtgccagcatgtgtatagcaacttgcatgagctcatggcatgcatcacaatcttcgaaggattaacagtacaatcttgatcaagtctctatatccaacatataataattagtcgatggaaggggacagatagctatctatagcgataaagcgcgtgtgttgtgagttgtgacacgtatatatcagtatatcacacgctatgtc

SEQ ID NO: 267 - DNA, 2107 bp, Zea mays
aagaattcggtgccggtgcgaatttcacgtcgccggcggcaggaaacagtagctagccacggcagtctcgtgtataattttttcgcggccgtttgcatgtggaacgccggaaaccagcgctaggatgtttcgcgattcggtggcggaaactgctgctgagtttcgccatttcttcgtgtggtcgccgcgccgggtgattatttcgtcggggacaggcggacagccagacaggtctcctcgttgacgaaacatgtctttagcaattactagcatgcacaaatttattcatttactaatcggcgagatcgacgatgacactgtgaaataaaactttcctagctgttcatatctgaactgataaaaagctggaggaaacataggcctaagccaactgatgtcagattcgaacagtgctggtggactgatggtggcgccgtacctaacatggcttgtcgctgatcgaacatccagcttggtgcgcgtggcaggttaggccaacttcagctctgttcgtgtcacgcgagtactcgtgctaagctaacaacaaaggtcatgatcatgatggctcatgagtccagtttagatggagttgccgtcgccgtcgccatacacgaagcgcttgacgagccggaccaactcgctgctggcgtcgctggccggctccacggtgaagaacccgtggtgctgaccctcgaactcgacatgctccacgggctgtcccatcgccttgagccgcgcgacgtagtccgcctggcggtcgcgcagcaggtcctgccccgcggccacgacgagcgtcggcgggagcgcgacgtcgcgcaggcccagcagcgcggggctctccggcccgaacgggttcgcgaacgggtggtccctcgtggcgcccggcggcagcgccagccgccaagcctggtcgtaccacggcagcgtcaggaacgggccgggcgggaactccgcctcggacgccgtcctctcggccccgccgaagaacgggcagagcatgacgtgcccggcgacgcgtaccgggtcgagctcgcccgaggccgccgagccgaggcggcggacggcgacgtggtggacgatgttcccgcccgctgagtcgccggcgacgaacacccggcccgggtcagccgagtcggcgagccaggggtcccctccccccgccgcgacggcctgggcgcgcacccagcgcatgacggccgccgcgtcgtcgagggccgcggggaggcggtgctccggcgcgaggcggtagtcggcggaaagcacgacggccgggagctcgccggccaggcggaggcagcaggcgtggaagctgggcagcgcgaaggtgccgaggacgtacccgccgccgtggaagtagaccagcacgggcagcttgccgcaggaggccggcggactgggactgtacacgcggagcttgaggccgtgggtggcgtcgtacacgacgtccttccaccggacgggcagcggcgcgggaggcacggacgggggagggagcgtgtcgtagtcggcgaagcggaccaccgtgccgtcgctgagaagctggaggacatggggcatgtcctcgacgacgtgcggcggcggcggcgaggaggatgacatcgcgggtgttggtgagagaagcccaggtggaggagcaacggggccagcaactgaattctacgtttatagagatgctgacgaggcgaggcgttaccagatctcagcggcaaatgcaaaccagccttccgtcttctcatcaatggcgcctttgtttcttctactactagcttgcttgtttcccaaggcccaagcacgtgtccctccaagattgaccaccgtgccgacgatgacgcctccaagattgaccaaccggactcccgcacactcgccgccgatgctaccgactgtttcttctgccgtgcctctgcagggaagatttgtctgctcatgatttggtatcgatccatgaatcagctgcgctggaccaacaatcccaattagggctgaaggtagaaattctcatttatttttttccccaccgaagcacttttgcaatgcaattcgatttttgcttggaaaacacaaccattttcttatgctgccgcatgaagttttcgagtttatgggg

SEQ ID NO: 268 - DNA, 1802 bp, Sorghum bicolor
ggaattttgaaaagttttggcctgagtcgctgataacaagtacgcactctatcttcattggtctcctcttggtcaatcttggaggcgtcatcggttgactgatactacgtgcttgggaaacaagctagcgaaaagcaaacaaaggcggcattgcccattgcggagaagacgaaaggctgatttgcatttgcctctgatataggagtatttgggaacgcctcgtcagcgtctactcctatatataaacgcagttgctgccttgatgtccgttgctcacagttcggtgcactgtgcttctcggtctctcgtaccaagctccaagtccaagctagctagctgtcagctctcacggtctcaccagcacccgcgatgtcatcctcctcgccgccacacgtcgtcgaggacatgccccatgtcctccagcttctcagcgatggcacggtggtccggttcgccgactacgacacgctccctcctccgtccgtgcctcccgcgctgcccgtccagtggaaggacgtcgtgtacgacgccacccacgacctcaagctccgcgtgtacagaccgccgccggactcctgcggtaataacaagctgcccgtgctcgtctacttccacggcggcggctacgtcctcggcaccttcgcgctgcccaatttccacgcctgctgcctccgccttgccgccgagctcccggccgtcgtcctctccgccgactaccgcctcgcaccggagcaccgcctccccgcggccctcgacgacgcggcgtccgtcatggactgggtgcgcgctcaggccgtcgacgcggcgggaggggacccctggctcgccgagtcggctgacctccgccgggtgttcgtcaccggtgactcggcgggcgggaacatcgtccaccacgtcgccgtccgcctcgcctcggcatcgggcgagctctcccccgggctcgacccggtgcgcgtcgccgggcacgtcatgctctgcccgttcttcggcggggcggagaggacggcgtccgaggcggagttcccgcccggcccgttcctgacgctgccgtggtacgaccaagcatggcggctggcgctgcccccgggcgccacgagggaccatccgttcgcgaacccgttcggtccggagagccccgcgctgggcggcgtcgcgctcccgcccacgctcgtcgtggccgcggagcgggacctgctgcgcgaccgccaggcggactacgtcgcgcggctcaaggcgacggaacagcccgtggagcacgtcgagttcgaggggcagcaccacgggttcttcgccgtggagcccgccggcgacgccggcagcgaggtggtccggctcgtcaggcggtttgtgtatggcaactcctactgactgaactgattgagtttgggactctgggtgctcgggcttgagccttgagtctgtcccatcatgacctttgttgttagcacgagcacgaagcactcgtgtcatggttatagtgaacgttttgtgttcactggataaaatgctcatcaataatagatttttttttgagaaattgctcatcaataatagatgcgtgtatgcatgggggagggggacagcccacgcgccatgggtccatggcttagcgagtcgaactgtgtgaaacgcacagagctgaaactagcacgagcaccaagctggattcgggactagaaattggaccggccaaatcggattgagtaataatcttcaagaaaattacctgctttcgaacttgatgaagaattgaacactgttcgatcagcgacaagccatgttagatacggctacggcgtcac

SEQ ID NO: 269 - DNA, 1972 bp, Setaria italica
gagaaaaaaaatggcatatagcggtcagcggaataccctgatgtaattttcctcactgatattcacatgcccacccaatccggcctgtgatcggatacaaccttgagcttcacggcatgtacgcatcacaccgttgtgaatggggacgtcatcagaaacctttcttttcctaggcaccttccaggttgcgtctgttgactggcacgtgcttgcacaaagtcacaaagccaaggaaagcaaacaccgttgaacatgagacgaaatgccgatttgctaccacctttggtcctttgcgattgcgtcgtcagtataaatggagcacttcctgcttaccacaccattctcgcgcctagctagactagctaacaccaacaccaacgatgtcatcttcgtcaccgccgcacgtcgtcgaggacttgccccacgtcctccagctcctcagcgacggcacggtggtccgcttcgacgactacaacacgctccctcccccggccgtacctcccgcgccacccgtccagtggaaggacgtcgtgtacgacgccgcccacggcctcaagctccgcgcgtacaggccgccggatgcctgcgggaagctgcccgtgctcgtctacttccacggcggcgggtacgtgctcggcaccttcgcgctgcccaacttccacgcgtgctgcctccgcctcgccggcgagctccccgccgtcgtcctctccgccgactaccgcctcgcgcccgagcaccgcctccccgcggccctggacgacgcggcggccgtcatgtcgtgggtgcgcctccaggccgcggcgggcggggacccctggctcgccgagtcggcagacttcggccgtgtcttcgtcgccggcgactcggccggcgggaacatcgtccaccacgtcgccgtccgcctcggctctggcgagctccccggcctcggcccggcgagcgtcgcggggcacgtcatgctctgcccgctgttcggcggggtagagaggaccgcgtccgaggcggagctcccgccgggcccgttcctgacgctgccgttctacgaccagatttggcggctggcgctgccgcggggcgccacgcgggaccacccgtttgtgaacccgttcgggccggagagccccgcgctgggcggcgtcgcgctcccgccgacgctcgtcgtggccgccgggcgcgacctgctgcgcgaccgcgtggcggactacgccgcgcggctgagggcgatggggaagcccgtggagctcgtcgtgttcgagggccagcaccacgggttcttcgtcgtggagcctttcggcgaggccgccagcgaggtggtccgcctcatcaggcgcttcgtgtacggcgacggcagcgctgactccaagtgagtttgggtgcttcagctctaatccgtccatgtgacagaatgttcagcatccaatggtgctgctgtcatgggtcctttgttgtttgttggagtactcggaccatggttgcgttgaacatttttgtagttgtatgggcaggctttgcaagtctaatttggaatagtgactgtccatgcacgaagcacaaattggcccatgcagctacagtagtgaacagtgactaccacgatcatgatgcgttccgatatagtttaacctgtcgctgacactgacagaatgatggctcaggaactagaaagtggaataggggtgtttgatacgagctgctatactaataattgcacagatgacgcctaattcgcgtgacgaatctattaagcttaattaatccattattaagtaaatgtagcaccatattgtcaaatcatgaactaattaggtttaatagatttgtctcgctaattagactccatctgtgcaattaattttataattagattatgtttaatatttctaattagtatcaaacatccgatgtgacagacaaacactccctaatagggctgataaaatcagagcatccttcaccagcagtaacttgcaaa

SEQ ID NO: 270 - DNA, 2070 bp, Sorghum bicolor
gctatattggttctacttctacatctattccatttccagccataaccacgggctccccagtccggcgaacgaatcgacgaagctcgagctacgccaccaatccatccaacaccatgacggggaagaagaggacgttcgtgctctacccttcgctgggcgtgggccacctgatcccgatggtggagctagccaagcacctgctgcgccacggccacggcgcgctcatcgccgtggtcgacccacccgacaccgacgccgtgtcggccgccgcggtggcgcgcctggcggcggccaacccggccatcgcgttccgcctcctgccggcgccggccagcccggacgtcgtcggcgtgcacccggcgaagcgcgacaaggacacgctccagctcgccaaccccgcgcttcgtgacctcctgcgggactccctgcccggcgccgtcgacgcgctcctcctcgacatgttctgcgtcgacgcgctcgacgtcgcggcggaggtcggcgtcccggcatacttcttcttcgcctccgcggcgggggacctcgccgtgttcctcaacctgccgtacctctacccgaccctgccgtcgtcgttcagggaaatgggcgagacgcttgtgcgctgccccggcatgccgacaccgatccaggcgctggacatgccgtggacggtgctggacagggagagcgacgggaccaaggtccggatgtaccagtggaagcgcatcgcggaggcgaggggcgtgctggtcaacagcttcgactggctggagccccgagccctgacagcgctcggcgacggcgtctgcgtgcccggccggccgacgccgagagtcttctgcatcggcccactcgtcaacgacggcagcacaggtcagagcggcgagaggcacgagtgcctggcgtggctggacgcgcagccgaagcggagcgtcgtgttcctctgcttcggcagcaagggcgccttccccgccgcgcagttgcaggagatcgcccgcggattggagagctccggccaccggttcctgtgggtggtgaggagcccgccggaagaagagggccagtctcccgaactggacttggggcggctgctccccgcagggttcttggacaggaacaggggcagaggcatggtggtgaagaactgggtgccgcaggcgcaggtggtgcggcacgaggcggtcggcgcgttcgtcacgcactgcgggtggaactcggcgctcgaggccatcgtgtcggggctgcccatgatttgctggccgctgtacgcggagcaggcgctgaacaaggtgttcatggtggaggagatgaagatcgcggtggcgctggggaggtacgaagagttcgttagggcggaggaggtggaagcgaaggtgaggctggtgatggaggcggaggaagggaggattctccgggagaggctcgcggtggcgagggagaaggcgttggaggctactagggagtgcgggtcttctcaagtggcattcgcggagttcttgagagatttggacaagagcagctccgtaaacggagaatgcaattgatcaaggagtacaatttgaagtatctgataaattgaagtgtgctactgctagtgtggcagatgggactgcgaaatacgtactgtaataagtggctgtttgctacagctcacaacagcttcatgagctgttgtgagctgtttttttttaccaaacacttagggcttgtttggcacaactcaaattcacaagtaaaactgtttttttagaaaataactttatgagtgattttctagatgaagctgagctgttttggagaaagtgtttgacaaaatagcttcaccaactacttcatacatagttgagagagagaaatgagagagaagctacaataagctatttttttctagcttcatctaacttatatctttgtgagaggagggaaaaaacaacttcacccatgaagctgttttggaaagaagtgtttggtaaaaaaaaatagctcataacagctcacgaagctgttatgagctgtaccaaacaagcccttatttctaaaacagctttatggatgaagctgtttttcccctcc

SEQ ID NO: 271 - DNA, 2018 bp, Setaria italica
attgaggattgaaagcgacaggaaacatgggaatctagtgcgaaccgcaccagagagcattccacgaacgcgcccctctccctcttttctgaaaagatttatgatgccggcagctgccggttctttatcaattcgtcaggaccagtagatcgcccgttcagttggtccaatttccgctctgccaatcccagtccagttcacagctgcagcagccctggacggaagctggaattgaagctccaggccggcgatccatggcgaagaagacgttcgtgctctacccgtcgctgggcgtgggccacctgatccccatggtggagctggccaagcacctcctccgccacggcatcggcgcgctcatcgccgtcgtcgacccgcccgacaccgacgccgtgtcggccgccgcggtggcgcgcctcgcggcgaccaacccggccatcgcgttccgcctcctgccggcgccggccagccccgacgccggcgcgcacccggtgaaacgcagcctcgacacgctccgcctcgcgaaccccgcgctgcggggcctcctccgctcgctgcccgccgtcgacgcgctcctgctcgacatgttctgcgtcgacgcgctcgacgtcgcggcggagctcggcgtccccgcctacttcttcttcgcgtccgcggtgggggacctcgccgtcttcctcaacctgccgtacctctacccaacccttccgtccttcagggacatgggcaagacgctggtgcgctgccccggcatgccgccgattcaagcgctggacatggtgataacgatgcaggacaaggagagcgacccgaccaaggtccggctgtaccagttcaggcgcatcccggaggggagcggcgtgctggtcaacagcttcgactggttggagcccagggccctgaaggcgctcgaggacggcgtctgcgtgcccggccggccgacgccgagagtctactgcatcggcccgctggtcaacgacgggaacaagggggagaacggcgagatgcacgagtgcctcgcctggctggacacgcagcccgagcggagcgtcgtgttcctctgcttcggcagcaagggcgccttctcggccgcgcagctacaggagatcgccggcggattagagagctccggccaccggttcttgtgggcggtgaggagcccgccggaagagcatggccagtttcccgaaccggacttggagcgactgctcctggcggggttcttggagaggacgaggggcagaggaatggtggtgaagaactgggttccgcaggcggaggtggtgcggcacgaggcggtcggcgcgttcgtgacgcactgcggatggaactccgcgctcgaggccatcatgtctgggctgccgatgatatgctggccgctgtacgcggagcaggggatgaacaaggtgttcatggttgaggagatgaagatcgcggtggagttgcaggggtacgaggagcttgtcaaggcggaggaggtggaagcaaaggtgagactggtgatggagactgaggaagggaagatccttcgggagaggctcgcagtggcaagggagaaggcgctggaggctaccaaggaagggggttcttctgaagtggcattcgccgagttcttgagggatttggagaagaagagcagctacggaaatgggaaatgtcgctgatcaaagcacttctatacttaaggattcaaatatcaccgattttgtcatcgatataaacaaattaaatgttgcatctgtagtatttcagtagaaattggaccagttagttggcaaagtcgtcaagcagagagccactggtgtgctaaattcaggatctcaacgtgattgtcaattgttaattctccgaatcaagtccccgaatattgtacttatcatatcttatagcagaattggatttgtgctagaatatgctaatgaggtaagtttgcagttttaccttagccacagcttggtaggggcagtccaatagatactacatctgtgtcaactcttacttcaatgttctgaatcgac

SEQ ID NO: 272 - DNA, 1491 bp, Sorghum bicolor
aaatgtggaaggaaggaagcctggaagaggaaaggaggaggaagcagcagcagcagctggaacacaggggcagtgacgccagcagagcttgtcgtatccagccgccctacgtcacgcgagagaggggcgcctgtcacgtgcccccccagcgccttgccttttcggtcgatcctgcgggtgtaatggaggagtacgcctcttacatgtttagcggcagcatgcatagctacggcggcgttggcggcggcgccatggccacggacgcggcgttggacaccggcggggacgacatgcagcacctgctcaacgcgctgatgctcgacatggccgccgagtccgactccttctcagacgacatggaggccgcctcctccgagtcctcctcctccgcctgctcggccaacagccacgaggccagccggcggccgccgccgccgcagcagcagcagcagccggacgacggcgaccgcaccaccagcgatgacaacaacaaatgttccaagaagcagcagcagcagcctttcatcggcgtgcgcaagcgtccgtggggcaagttcgcggccgagatccgcgactcgacgcgcaagggcgcccgcgtgtggctgggcaccttcgacagccccgaggccgcggcgatggcctacgaccaggcagccttctccgtgcgcggcgccgccgccgtgctcaacttccccgtggagcgcgtgcaggagtcgctgcgcgcgctcgcgctctcctccgccgccgcctctgccccgggcggctcccctgtcctggcgctcaagcgccgccactccatacgcaagcgctccccgaacaagaacaagaggcagcaggagcagcagcagcagcaccaacaggtggccgtggccgccgcaccacagcagcagccgccgccgtgccccggcggcaacgttgtggagctggaggacctcggcgccgattaccttgacgagctcctccgggtgtcgtccgagttcgattggcaataatccatggtaaatggcggccctgcaagtgcaacgtgcaagcgaagcgaggctttagttgtagtggatcgagttcagttgccatcagaattcagaaagcatgcagattgcagagcactcctgctgccctgccctgtcttcgctcgccaattgcgagatcgacgacgacttgtgctcatctttttcttggacatatactcgcttgtgtttaatctgtgcaggccccaccactggtctctgttgcttcagttttcctgtgtcaattttctcaaacacggctgagagtacacactaattaaacgctaatacatactactcagctatataaatacaagcatgcaccctaaaagaattattaagttctttatttagattaaatttaataattaacaaagtcaccataatatgtccgagtacgagaaactaactagttgaggcgttgagatactttctgtttgctttcttttcttgagctcccaaggcccaaggtgtttgtctgtca

SEQ ID NO: 273 - DNA, 1586 bp, Zea mays
gagacacaaacctagcgcaacaagcaatcgaaaaagagatttggctacaaccaattaaccatattggccagcagtgtacgtgggaacgatggccctcatgcaggagagtagtagccaggatttgctccaagctcacgacgagctcttgcaccattccctgtgcttcgccaaatcgctcgcgctcgccgtggcgctagacctccgcatccccgacgcgatccaccaccacggggccggcggcgccacccttctccagatcctcgccgagactgcgctccacccaagcaagcttcgcgcccttcgccgcctcatgcgcgtgctcaccgtcacgggcatcttcagcgtcgtcgagcaaccaccagcaggtggtggtgatgattcaaccgtccacacgtcggacgacgaagctgtcgtcgtctacaggttgacggcagcctcccgcttcctcgtcagcgacgacgtgagcacggcgaccttggctccctttgtgagtctggcgctccagcctatcgctgcctgtccgcacgccctgggtatctccgcgtggttccggcaggagcagcacgagccgtccccgtatggcctggcgttccgccagaccccaacgatctgggaacatgctgacgacgtaaacgccttgctgaacaaaggcatggccgcggacagccgcttcctcatgccaattgtgctgagggagtgcggcgagacgtttcgtgggatcgactcgttggttgacgtcggtggtggccatggtggcgccgccgccaccatcgccgccgccttcccccacctcaagtgcagcgtgcttgacctcccgcacgttgtcgccggtgctccgtctgatggcaacgtgcagttcgtcgcaggcaatatgtttgagagtattccacctgcaaccgctgttttcctcaagaaaactctacatgactggggtgacgatgagtgtgtcaagatattgaagaattgcaagcaagccatatctccacgggatgcaggtgggaaggtaataatcttggatgtggtagttggatataaacagtcaaacataaagcatcaagagacacaagttatgtttgatttgtatatgatggcggttaacggagttgagcgtgacgagcaagagtggaagaagatcttcactgaagctggattcaaagactacaaaattctacccgtcattggtgatgtatcggtcatcatcgaggtctatccttgaatgctttgtgaacaaaggcctccataataaactgaagaccaagaaggtgttgatagtatattatgaattgttatttgtcctgtacacttgattctttgcgtatttgtaatgacaagttgagtaattgtgtttttgttaatgtggtgttatgaagcgcatttcaagttacaagcgtaccagtggcggacctagaaaacttcaaaatcctgggcatttgatttgcgagatagaccttgccaatttttactcatgccaacctacattttgctccttgaatacgtatacttgtccacaacatacgatagacgagcccggacagctacacatggtagccgagcgttgaattcgccactacctggaccggttgtac

SEQ ID NO: 274 - DNA, 1514 bp, Zea mays
cacaaggttcattcgtctctgcacccacaaacccagttatatagctagcaatcgagagaaagccaactagcagtatatacgttggcacgcacgaatacgatggcactcatgcaagagagcagtagccaggaccaggacatgctccaagctcacgacgagctcttgcaccattccttgtgcttcgccaaatcgctcgcgctcaccgtggcgctggacctccgcatcccagacgccatccaccaccacggcggcggcgccacccttctccagatcatcgcggagactgggctccacccaagcaagcttcgcgccctaggccgcctcatgcgcgtgctcaccgtcacgggcaccttcagcgtccagcaaccaccagccggtagtgacgacgacgaagctgtcgtcgtctacaggctgacagcagcctcccgcttcctcgtcagcgacgaggtgagcacggcaacaaccttggctccctttgtgagcctggcgctccagcctatcgctgcctctccgcacgccctaggcatctgcgcgtggtttcggcaggagcagcacgagccgtccccgtatggcctggcattccgccagaccccaacgctctgggaacatgctgacgacgtaaacgccttactgaacaaaggcatggtggcggacagccgcttcctgatgccaattgtgctcaggcagtgcggcgagatgtttcgtggcatcaactcattggttgacgtcggtggtgggcatggtggcgccgccgccgccatcgccgctgccttcccgccactacaggagaagcctaaaatttctgcgcacgtcaagtgcagcgtgcttgacctcccgcacgttgtcgccggtgctccatctgatggcaacgtgcagttcgtcgcaggaaatatgtttgagagtattccacctgcaaccgctgttttcctcaagaaaactctacatgactggggtgacgatgagtgtgtcaagatattgaagaattgcaagcaagccatacctccacgggatgcaggtggaaaggtaataatcttggacgtggtagttggatataaacagtcaaacataaagcatcaagagacacaagttatgttcgatttgtatatgatggccgttaacggagttgagcgtgacgagcaagagtggaagaagatcttcgccgaagccggattcaaagactacaaaattctacccgtcattggtgacgtgtcggtcatcatcgaggtctatccttgaatgctttatttgtgaataataaagggcgcctaattcataataaacctaggattgtgaaggcgctggtagtacattaagaattgttcctttttattaccatgtgcttgaacctttggacaatttgtaatatgagaaggtgagcaattgtgttttgttaacatgcatggtctcttgcattggtacgtggtgcgcattctacgtgatgcaatgtatgagaaacgctatgtggtgcacgttgggccggtagacatctctactacgcgtctacgccgccctgg

SEQ ID NO: 275 - DNA, 1387 bp, Zea mays
atttttttcacttacccctaactaacacgatggcactcagcactcaggacttgctcgaagctcacgtcgagctctggcaccagtccctgtgctacgccaaatcgctcgcgctcgcagtggcactggacctccgcatccccgacgcgatccaccaccatggcggcagcgccacccttccccagatcctcgccgagactgcggcccacccaagtaagcttcgcgctctacgccgcctcatgcgcgtgctcaccgtctcgggcaccttcagcgtcgagcaacaaccgccagctggtggtgatgattcgaccgtcgacgcgccggacgaagctgtctacaggctcacggcagcctcccgcttcctcgtcagcgacgaggtgagctcgtcgaccttggctccctttgtgagcctggcgctccatcctatcgctgtctctccgcacaccatgggcatctgcgcgtggttccggcaggagcagcgtgaaccgtccccgtatggcctggctttccaacaaacattcccaacgatctgggaacacgctgacgacgtaaacgccttactgaacaaaggcatggtcgcggacagccgcttcctgatgccaatcatgctcagggagtgcggcgaggtgttccgtgggatcgaatcgttggtcgacgtaggcggtgggcatggtggcgccaccgccgccatcgccgctgccttcccgcacctcaagtgcagcgtgcttgacctcccgcacgttgtcgccggcgctccgtccgatgtcaacgtgcagttcgtcgcaggcaatatgtttcagagtattccacctgcaaccgctgttttcctcaagaccactttacatgactggggtgacgacgagtgtgtcaagatattgaaaaattgcaggcaagctatatctccacgtgatgcaggagggaaggtaataatcttggacatggtagttggatacgggcagccaaacataacgcatctagagacacaagttatgtttgatttgtatattatgacggttaatggagctgagcgcgacgagcaagagtggaagaagattttcatagaagcaggattcaaagactacaaaatcctaccaatccttggtgcactatcagtcatcgaggtctatccatgaatgcttgctgagcaaaggcctccacaataaattgaagaatctgaaagtgctgatagtaatccatgaattgttctttttactatatacactttgaagcacatcgtcgtgtgtgcttccacatgtgatacgatatgtaaacgatgtgctatatatattacccatgctctcgttcgatgtagatgctgggatcataggtaaatctactatatatgccagatcttaataagataatatggaagcgttttgcttgtttgtgc

SEQ ID NO: 276 - DNA, 1665 bp, Zea mays
ggaacgattcctaaccggattgcttctctaatttatataaactttgattagctggaacgattccgggtgcaatccgacacaaacgaataaggccttagctggaacgattgtgggtgcaatctgacataaacgaacaaggcctaaggaatctgattggcaccagaaagttaataaacacacctttaggccttacctcaagctagcagaacactagctagcgctatataaactgcctagcggctagctagcgcaagcaatcgagaaagagaattagctatagccagccgtgtgtcgaacacgacacgcgataatggcactcatgcaggagagcagccaggacttgctcgaagcgcacgacgagctcttccaccactgcctgtgcttcgccaaatcgctcgcgctcgccgtggcgcaggacctccgcatccccgacgcgatccaccaccacggaggcggcgccaccctccaccagatcctcgccgagaccgcgctccacccaagcaagcttcgcgccctacgccgcctgatgcgcgtgctcaccgtctcgggcgtcttcaccgtccagtattcttcaaccgtcgacgcgtcggacggagctgatgtcgtctacaggctgacggcagcctcccgcttcctcgtcagcgatagcgacgaggcgggcacggcgtccttggctccctttgcgaacctggcgctccaccctatcgccatctccccgcacgccgtgggcatctgcgcgtggttccggcaggagcagcacgacccgtccccgtacggcctggcgttccgccagatcccgaccatctgggagcatgctgacaacgtaaacgccctactgaacaaaggcttgctcgcggaaagccgcttcttgatgccaatcgtactcagggagtgcggagacgaggtgttccgtgggatcgactcgttggtcgacgtcggcggtgggcacggtggcgccgccgccaccatcgccgccgcattcccgcacgtcaagtgcagcgtgcttgacctcccgcacgttgtcgccggtgctccatccgatgcctgcgtgcagttcgttgcgggcaatatgttccacagtattccacctgcaaccgccgttttcttcaagacaactctatgtgactggggtgacgacgagtgcatcaagatattgaagaattgcaagcaagccatatctccacgggatgagggtgggaaggtgataatcatggacgtggtagtcgggtatgggcagtcaaacatgaagcgcctagagacacaagttatgtttgatttggttatgatggcggtcaatggagtcgagcgcgacgagcaagagtggaaggagatgttcattgaagctggattcaaagactacaaaatccgaccagtagctggcctcatgtcggtcatcgaggtctatccatgaattctttgtgaacaaaaggccggctgccataatataaactgaagaccacgacgtcgtcatggagctgagcgtgttgttttttagactactaggcacttgagcctctgagaatttgtaataataaataagctgagcaacagcgttctgttaatgtggtcttgccttgcacgttctacacaccaattccgtcggcctaactaatactatacaaaccgtcggaaataagcaacttgcccacgggcgccgtcatgaat

SEQ ID NO: 277 - DNA, 1681 bp, Zea mays
atgttcctatacggagcaacaccgacaggcgggggccattttccagtccagttcctattcctccacaatattcagttccgctggatcaacggacgtgaactcaccctcctgcgagaacaagccgctggcctcgacaaccttcctctgcgggatgtggctgatcttgagccggtcgtcatcggtcagctcccagtcgaatatctcgaggttctgcttcagcctctccctgttgtagctcttgacgatgcacgtcactccctgctcatgtatccatcgcagcgccacctgtgccacggtcttccccctcgccctggctatctccgcgagcacctccgagtcgagcacggcgttgccccgcccgtcccagttctgccctcccagcggcgagtaggcggcgacgtggacgccccggtcggcgcagtacgcccgcagcgtccgctgctgccacgccgggttcagctccacctggttcaccgcgggcgggaccgcggccacggccaggaccttgtccaggtgcctggtggtgaagttgctgacgccgatcgccctggcgaggcccagccgctggcactcctccatggcgcgccacacgcccgccacgtccagcggcaccgcgtcctccttcctgttcgggaacttgggcggcccgccggccggcctgaggcacaccggccagtggatcaggtacaggtccacgtactccatctgcaggttctcgagagtttcccgcagggacggcagcacgaggtccgcgtgggtctgcgagcaccacagcttggacgtgacgaagagctcctcccgggacctcaggaggccgcgccgcagcgcctcggccacggcgtcgccgagcggcttctcggtgccgtacaggaaggccgtgtcgaagtggcggaaccccacctcgatggccgccagcacggcgtccctgacggcctcgtgcaccacggggaacgacgccgtgcccatgcccaccatcggcatcggcttcccgttgcccgaccgcagggtcacctccggcaccgccgccgccgtcgtccccgtggatgccatgctgatgcggtcaagtatggcgcgctgcagttggaggtgcgtctagtctaggtgtgcggtgcggaacagggagggacaggggtgcgcgagccagagccttgagcccgtgctggtatgtggacaggcgacgtgtgggctctcggtacttcatcgcgttggcattcagcagatgggacccgacggggacttttaccatcggagtagtgttttgacgtcaccagttacgcttccacagctcttgccgtggcttgctttgtctgcctaggcaaaagaaaaccagcgtttggtgaaagggagaacattttggatcttcccgaggtttccagggcttgacaacccctccacgaggatgaaatcggccacacaattgccggacgaccgcaagacaaagcttgggcctagacggcttcgtatgcccttttttttcttcttcttcttcaagtaacgatgctcgtagatcataatgccaactacagcaacgccgtgcataaagacatgtataacaccgttttgtaacgtagatgtactgtcttcaaaaagaagtttaaaataggaaacaaaataattgagtgagatagggagtctgttttgatagtttaaagcaggatacgtcgacgacaacatatatttt

SEQ ID NO: 278 - DNA, 1294 bp, Zea mays
accccctctctgtctctcgcatctagtctagacgttgtactgcagcggcagcgcaccacatctgaccctaccaacatggcatccgcggggacgacggcggtggtgcccgaggtggccctgcggtcgggcaacgcgaggacggcgatgccgatggtcggcatgggcacggcgtcgttccctctggtgcacgaggccgtcaaggacggcgtgctctccgccatcgaggtggggttccgccacttcgacacggcctccatgtacggcaccgagaagccgctgggcgacgccgtggccgaggcgctccggcgcgggaccctgcggtcccgggaggatctgttcgtgacgtccaagctgtggtgctcgcagaaccacccggacctcgtgctgccgtccctccgggaaacactcaagaacctgcagatggagtacgtggatctgtacctgatccactggccggtgtgcctgaaaccggggccgcccgagctcccgaccaggaaggagaacgccgtgccgctggacctcgcgggcgtgtggcgcgccatggaggagtgccagcggctgggcctcgccaaggcgatcggcgtgagcaacttcaccaccaggcacctcgacggggtcctggccgtcgccacggtcccgcccgcggtgaaccaggtggagctgaacccggcgtggcagcagcggacgctcagggcgtactgcgccgacaggggcatccacgtcgcggcctactcgccgctgggagggcagaactgggacgggcagggcagcgccgtgctggactccgaggtgctcgccgcgatagccaaggcgagggggaaaaccgtcgcgcaggtggcgttgcgatggatacatgagcagggagtgacatgcatcgtcaagagttacagcaaggagaggctgaggcagaaccttggaatattcgactgggagctgaccgacgaggagcggctcaagatcagccagatcccgcagaggaaggttgtccagactagtagcttgttctcgcaagagggtgaattcacggctgtggatccagcggaacttaatattttagaggaatagggggaaaatgacccgccacacatacactgcatcagtgttgcactgttgctgcatacagaactcagaagtgtatttcgtagaccatttgaataaggctgttggaaacggtgacatctagtgctgtttgtgtttcgttgccgggacggtaacatctacagttaatgctgcaatccattaacggaacggaggggaatggatagcgctcgtttatgagtggtttcattactgt

SEQ ID NO: 279 - DNA, 1445 bp, Sorghum bicolor
tccgccaccacgtccacgtccacgattaattgcaatactcgtacataaatcgacacggcacgggctctcctgtccttgttccgcaccgagacgtgtaaccgcagcgcaccactctgacctgcaggcgcatcatgagcatggcagcatccacggcggcggcggtggcggtgccggaggtgtccctgcggtcgggcgacgcgaggccgatgccgatggtcggcatgggcacggcgcagttccccgtggtgaacgaggccaccaggaacgccgtgctggcggccatcgaggtgggtttccgccacttcgacacggccttcttgtacggcaccgaggagccgctcggcgaggccgcggccgaggccatccgccgcggcctcgtccggtcccgggaggacctgttcgtgacgtccaagctgtggtgcacgcagaaccacccgcacctcgtcctgccgtccctccgggaaactctcaagaacctgcagatggagtacgtggacctgtatctgatccactggccggtgtgcatcaagcccgggccgcccaagttcccgaacaagaaggaggacgcggtgccggtggacttcgagggcgtgtggcgcgccatggaggagtgccagcggctggggctcgcgagagccatcggcgtcagcaacttcaccaccaagcacctcgacagggtcctggccgtcgccacgatcccgccggcggtgaaccaggtggagctgaacccggcgtggcagcagcggacgctgagggcgtactgcgccgacaggggcatccacgtcgccgcctactcgccgctgggcgggcagaactgggacggccagggcaacgccgtgctggactccgaggtgctcgccgagatagccaaggccagagggaaaaccgtcgcgcaggtggcgttgcgatggatacatgagcagggagtgacgtccatcgccaagagctacaacaaggagaggctgaagcagaaccttgagatattcgactgggagctgaccgaggaggacaggctcaagatcagccagatcccgcagaggaaggttgtccaggctaccagcttgttctcggaagagggtgagttcacgtctgttgatcctgaagaaatgaatattgcagaggaatagcaactgaaaaaaatgttcggcctcgatcggtgttgctgcgtagtagaggagtacttcgtactagtccagatatgaataaggcaatgtttcatcctcagtgtgtttctgtgtgttgatgatgttttccatccccgttcagttcagtaaatattgtaatcataacattcagatgttgcatactccaagtccaattcgaggttatcataatttcgcatacacaaatgatcggtggccatcgtgctactgacgccattgttgtctttctcagttgttatttgtcttgtcatttgacacatcacgatggatggcgactcttca

SEQ ID NO: 280 - DNA, 1167 bp, Saccharum officinarum
cacgtccacgtccacgtttgcaatacataataaagcgaccgacacgcgcacccttgtcctcgttccgcaccaagaagctgcagcgcaccacatctgacctgcaggcgcatcagcatggcatccacggcgacggcgacggcggtgccggaggtggccctgcagtccggcgacgcgaggccgatgccgatggtcggcatgggcacggcgcagttccccgtggtgaacgaggccaccaagaacgccgtgctggcggccatcgaggtggggttccgccacttcgacacggccttcatgtacggcaccgagaagccgctcggcgaggccgcagccgaggcgatcaggcgcgggctcgtgcagtcccgggaggagctgttcgtgacgtccaagctgtggtgcacgcagaaccacccggacctcgtgctgccgtccctccgggaaactctcaagaacctgcagatggagtacgtggacctgtacctgatccactggccggtgtgcatcaagcccgggccgcccaagttcccgaacaagaaggaagacgccgtgccgctggacttcgagggcgtgtggcgcgccatggaggagtgccagcggctgggcctcgccaaggcgatcggcgtgagcaacttcaccaccaagcacctcgacagggtcctggccgtcgccacgatcccgcccgcggtgaaccaggtggagctgaacccggtgtggcagcagcggacgctgagggcgtactgcgccgacaggggcatccacgtcgcgggctactcgccggtgggagggcagaactgggacgggcagggcaacgccgtgctggactccgaagtgctcgccgagaataccaaagccagagggaaaaacgtcgcgcacgtggcgttgcgatggatacatgatcaaggaatgacgtgcatccgtccagagctacaacaaggagaggctgaagcagaaccttgaaatattcgaatgggagctgaccgatgaagatcggctccagaatcagccagatcccgcaaaggaaagttgttccaactaataactgcttgttctcgccacgaaggtaatttcacctctgttgaacctgcacaactgaatattgtagaagattagcccggctcgtgctgttgctagaggagtattcctactacttcaaatgaattagtgaacgtt

SEQ ID NO: 281 - DNA, 1737 bp, Panicum virgatum
ttttgtaaatagacttcatttagtacttcaaattgaccagattcattcaaaaaaaaaattttacgtctacatataaagtgaactaaacagagggcctttgtttggtttctgctcccgcacagccaggctggatcgagcaagtgattggttgccagactaccaacaacactcatgtactctttgtgtcactgcgcaaacacctaggcgaggtcgctcgcaccgcgccagtcaggccacgcggaaacgaccgatttcttcgtttccaatcccgcgagcctggcccgggggcgggttttgcatctagccaaccagcccccaacactacccaggcatccaatcacgggggtcttgtaccccgggagcctggttggctcgtatgcggccaaccagtcaggcccaaagcgaccggcacgtacgggctccatcacgccacgcgcgctcctgctccgtcgtccctgcacctagacgtaaccatcgcagccagcgcgacgcatctgacccgcggagaccaggcgcgcacggcgcatcgcatcggcatggcgtccgcggcggtgccggaggtggccctgcggtcgggcggcgcgcggccgatgccggcggtcggcatgggcacggcgacgttcccgccggcgcccggcggggtcaccaaggacgcggtgctggcggccatcgaggtgggctaccgccacttcgacacggccgccatgtacggcacggagcggccgctcggcgacgccgtggccgaggcggtgcgccgcgggctcctccggtcccgggaggaggtgttcgtcacgtccaagctctggtgcacgcagagccacccggacctcgtcctcccctccctccgggagaccctcaagagcctgcagatggagtacctggacctgtacctgatccactggccggtggccctcaagcccgggccgctgactttccccaacaggaaggaggacgccgtgccgctcgacttggagggcgtgtggcgcgccatggaggagtgccagcggctggggctcgccagggccatcggcgtcagcaacttcaccaccaggcacctcggcagggtgctcgccgccgccgccgtccccccgcggtgaaccaagtggagctcaacccggcgtggcagcagcgggcgctgcgggcgtactgcgccgacaagggcgtccacgtcgcggcctactcgccgctggggggccagaactgggacggcacaggcagcaacgccgtgctggagtcggaggtgctcgccgggatcgccagggcgagggggaaatccgtcgcgcaggcggcgttgaggtggatatacgagcagggcgtgacgtccatcgtcaagagctacaacaaggagaggctcaagcaaaacctcgacatcttcgactgggagctgacggacgacgaccggctcaagatcagccagatcccgcagaagaagattgtcaaggccgagggtttgttctcgcaggagggtgagttcacgtccgttgatccagcggacctggacatcgtagaggaatagggaacgcggaatgatatgcgcccgcgcggctccgtatgaacatttgaataagaccaggcttttccgtgccgatgaagtaatttctttttgttacctccttgtaatgttgcgatatggaacgtttcctctcagtaaaagattgcatttggtaaatatttctagagggttttttttgaagatatttctagaggttttgatatgcagaatttgcttggttctct

SEQ ID NO: 282 - DNA, 1258 bp, Pennisetum glaucum
cctgatctgtccgcacctagacataatccattattgcagcgatacatacacccctcttcatctcttcagatcaggcgcatcaaccaccatggcatccacggcaacgacggcggcggtgccggaggtggccctgcagtcgggcgacgcgaggccgatgccggcggtcggcatgggcacggcgtcgttccccctggtgcccgaggccaccaagaacgccgtgctggcggccatcgaggtgggctaccgccacttcgacaccgcctacctgtacggcacggagaagccgctcggcgaggtcgtcgccgaggcggtgcggcgcgggctcgtcgcgtcccgggaggagctgttcatcacctccaagctgtggtgcacgcagaaccacccggacctcgtgctcccctccctccgggagaccctcaagaacctgcagatggagtacctggacctgtacctgatccactggccggtcgccatgaagcccaagccgccgaccttcccgagcaagaaggaggacgccgtgccgttcgacatcgagggcgtgtggcgcgccatggaggagtgccagcgtctgggcctcgccaaggcgatcggcgtcagcaacttcaccaccaagcatctcgacagggtcctggccgcctccaccatcccgccggcggtgaaccaggtggagctgaacccggcgtggcagcagcgcacgctgaggacctactgcgccgagaagggcatccacatcgccgcctactcgccgctgggagggcagaactgggacgggacgggcaacgccgtgctggagtcggaggtgctcgccgggatcgccaaggcgagggggaaaaccgtcgcgcaggtggcgttgcgatggatatatgagcagggagtgacgtccatcgtcaagagctacaacaaggagaggctcaagcagaacctggagatcttcgactgggagctgaccgatgaggaccggctcaagatcagccagatcccacagaagaaggttgtcaagcacagtggcttgttctctcaggagggtgaatttacgtctgttaatccagcggacctgaacatcgtagaggaataaggactgccaagtggacccgtccgctctgtagacagtagcatttgaataagcaggtttgtgttcaccgtttccggtgtctttgctcgtgttgatgctgtaattttccttcattaatgttgcgatgtgcaaacgtttcgtctcggtaaaagattgtgatcgcttgtcatattcagaggttgccgt

SEQ ID NO: 283 - DNA, 3393 bp, Sorghum bicolor
tctcgcgaaactaccccggtcccggtggaaacgaaaaggcagtagtatcggcggacttgtcctttacttctctgcgtgtgcgtgctcatagtcatggtccgatcccttgccccgatactccatcaggagcagtcctctcattagcttgtcggggcttctcttgtattctcggattgtcgctgaagcaaggaaggagggaaagctagcgccaagtgactgacccacagcccacagcaccctgtttctgtttgttctctagcttctcctcgccgctttgctctcatctcagcatccatatgggaccatggatattatatggtaggagtagatcatatccttgcagccagccgcagcccgcaggtaggtagcgtgctttcttggggtcggcggctatcgtatcgtcgtgctggaggggcgcggcagtagctagtgtgtatatatatactgcgcgtataccttgtgttggcctccctcatgctcatcggctcgcccgcccggctgccctccacaagaagctagcttgggcaggcagcagagtctagctaaggcggcggcggaagaggatcgggtcggaggaggagatctcgatcgaagaagccgcgcccaaccaacatgatgatggcacagcagccacagacgacgcagctgctgctgcacggggtgatcgacgccaggatcctcgaggccgacctgtccgtcaccacggacggcaagctgcagccgaccaagaagactttgatgaagaagaaggtcttctcatggatcaggaagctgaccttctgcaaaggccagctggagaatgccatcggcctgggcacggacggcaagctgtacgcgacggtggacatcgacaaggcgcgcgtggggcggacgcgcatggtgccccccgtgcactcccccaagtgggacgagtccttccacatctactgcgcgcacgacgccagcaacatcatcttcaccgtcaaggccgacaacgccatcggcgccacgctcatcggccgcgcctaccttcccacggagggcgtcgtcgccggccagaaggtggacctgtggctccccatccgcgacgagaagcggcagccgctggaaggcggtgaccagatacgcgtccagctccagttcaccaacgtcgccgccgacccgaccgccgggtggggcaccggcgtcggcagcggcgcgtacggcggcgttccctacaccttcttcaagcagcgccgcggctgccgggttcggctgtacgaggacgcccacgtcgccggcgacttcgcgccgcgcgtccggctcgcggacggcagcttctacgagccgcgccggtgctgggtggacgtgttcgacgccatcaacagggcccggcggatggtgtacgtcgccgggtggtccgtgaacacggacgtcgtgctggtgcgcgacccgcgggagccgtcgtcggcgtcgtccgagaacctcggcgagctgctcatccggaaggcgaacgagggcgtcgcggtgctgatgctggtgtgggacgaccgcacctcggtggggctcggccccatcaagcgcgacgggctgatggccacgcacgaccaggacacggagagcttcttccgcgacacgcgcgtgcagtgcgtgctgtgcccgcggaaccccgacaaggaccggagctacgtgcaggacatcgagacggccaccatgttcacgcaccaccagaagacggtgatcgtcgacggcggcggcggcaggacggggccggagtcgccgccggggctcgtgagcttcctcggcggcatcgacctgtgcgacgggaggtacgacacgcaggaccacccgctgttccgcacgctgggcaccacgcacagcagggacttccaccagccaaacttccccggcgcgtccatcagcaagggcgggccgagggagccgtggcacgacatccactgccgcgtcgagggccccgcggcgtgggacgtgctggagaacttcgagcagaggtggaagaagcagggcaagggcgacaacatgctggtggcgctcaacaaggcgtgggcggagcgcgaggcggccgccggcgacgcagagtcgtggaacgtgcaggtgttccggtccatcgacggcggcgcggcggcggggttcccggagggctccgccgacgcgcccagggaggccgcggcgctggggctggtgagcggcaaggaccacgtgatcgagcgcagcatccaggacgcgtacatccacgccatccgccgggcgcgggacttcgtctacatcgagaaccagtacttcctggggagctcctacgcgtggcggcggcagaacgacggcgtgacggtggaggacatcaacgcgctgcacctcatccccaaggagctgtcgctcaagatcgtcagcaagatcgaggccggcgagcggttcgccgtctacgtggtggtgcccctctggccggagggcgtgccggagagcggctccgtgcaggccatcctcgactggcagcgccgcaccatggagatgatgtacagggacgtcacgctggccattcgcgccaaggggctccaggacgaccccagggactacctcaccttcttctgcctcggcaaccgcgaggcgccgagccccggcgagtacgtgccgccggaccacccggaccccaacaccgactacgagagggcgcagcaggccaggcgcttcatgatctacgtccatgccaagacaatgatagtggacgacgagtacatcatcgtgggatcggccaacatcaaccagcgctccatggacggcggccgcgacacggagatcgcgatgggcgcgtaccagccgggatacctggcgaccaggaaccggccggcgaggggccaggtccacggcttccgagtctccctgtggcaggagcacctggcccaggcggcggcggcggcggcgggcggagatctcctccgtccgtcgagcctggcctgcgtgcgccggatgaaccaggtggcgaagcagcactgggacatgttcgcgagcgacgcgttccggggcgacctcccgggccacctcatggcgtacccggtcagcgtgctcgacgacggcagcgtcgtggcgacgacggaatccttcccggacaccaacaacgccaaggtgctcggcaacaagtccgacatcctcccgcccatcctcaccacatgatttaatcatcgattatattgaccacccgccgtggaattgttgtttaatttattgttatgaagcgcaagtgagagaagcagcgtgtgtgtgacaagtgtcaagtggtaatgcaactattgtaaataccatcgacgtgtgttgtgattcatatgttaacaaaagcagaataatttaaaagctgaaacctgaaccctcttgttcctgtttccgaacaaacacctcacatgattgttggctttcaaccaagag

SEQ ID NO: 284 - DNA, 2836 bp, Setaria italica
gttccgtagagcccagcttgctctatcggacgggaagggctagtgtatataaactgcgcgcacaccaccttcttggcctcgtcggctcgctcggagcaagaagcacagagggctaggccaaggcggcggaagaggagctcggagaccaaggcgccgaacgccatggcacagctgctgctgcacgggttgatcgacgccaggatcgtggcggccgacctgtccgtcacgtcagatggccagctgcagccgaccaagaagactcggatgaagaggaaggtcttctcatggatcagcaagctgcccttctgcaaatgccagcggctggagaacgccatcggcctcggcacggccggcaagctgtacgcgacggtggacatcgacaaggcccgtgtcgggcggacgcgcatgctggaccccgtccactctccgcgctggaacgaggccttccgcatctactgcgcgcacgacgccagcaacatcatcttcactgtcaaggccgacaacgccatcggcgccacgctcatcggccgcgcctacctgcccaccagggacgtcgtcgccggccagaaggtggagcggtggctcgacatctgcgacgagaagcgccagcccctggaaggcggggacaagatccacgtccagctccagttcacggacgtcgccgcggaccccgagggcggctggggcgccggcgtcggcggcgcagggccgtacgggggcgtcccgcgcaccttcttcgagcagcgccgcggctgccgggtccgcctgtacggggacgcgcacgtcttcgacggcttcgcgccgcacgtccagctcgacggcggcaggccgtacgagccccgccggtgctgggaggacgtcttcgaggcgatcaataacgcccggcggatggtgtacatcgccgggtggtccgtgaacaccggcgtccagctagtgcgtgacccgcggcggccgtcgtcggagacgctcgggcagctgctcatccggaaggccgacgagggcgtcacggtgctgatgctggtgtgggacgaccgcacgtcgggggggctcggcccgatcaagcgagacgggttgatggccacgcacgacgaggacacggcgggcttcttccgcgggaccagggtgcactgcgtgctctgcccgcggaaccccgacaaggaccggagctacgtgcaggacgtcgagacggccaccatgttcacgcaccaccagaagacggtggtcgtcgacggcggcggcgtcccggggccgaacgcgccgccggggctcgtgagcttcctcggcggcatcgacctgtgcgacgggcggtacgacacgcaggagcacccgctgttccacacgctgggcaccacgcacaacaaggacttccaccagcccaacttccccggcgcgtccatcaagaagggcggacccagggagccatggcacgacgtccactgccgcgtcgagggcccggcggcgtgggacgtgctcgacaacttcgagcagcggtggcggaagcagggcagcggcgacaacctcctggtcgcgctggacaaagcgtgggcgccgcgcgaggcggccgccggcgacgccgagtcctggaacgtgcaggtgttccggtccatcgacggcggcgcggcggcagggttcccggagaaccgcgacgaggcccccgacgaggccgcgcggcgcggcctggtgagcggcaaggaccacgtgatcgagcgcagcatccaggacgcatacatccacgccatccgccgcgcccgggacttcatctacatcgagaaccagtacttcctggggagctcctacgcgtggcggcagaacgacggcgtgaccgtggaggccatcaacgcgctgcacctcatccccaaggagctgtcgctcaagatcgtgagcaagatcgaggccggcgagcggttcgccgtgtacgtggtgctgcccatgtggccggagggcgtgccggagagcggctccgtgcaggccatcctggactggcagcgccgcacgatggagatgatgtacagggacgtgtcgctagccatccgcgccaaggggctccaggctgaccccagggactacctcaccttcttctgcctcggcaaccgcgaggcgccgcgccccggcgagtacgtgccgccggagcggccggaccccgacaccgactacgagagggcgcagcaggccaggcgcttcatgatctacgtccacgccaagacgatgatagtcgacgacgagtacatcatcgtgggatcggcgaacatcaaccagcgctccatggacgggggccgcgatacggagatcgcgatgggtgcgtaccagccgagccacctggcgaccaggaaccgaccggcgaggggcgaggtccacggcttccgggtcgcgctgtggcaggagcacctgggacaggcggcggcggcggcggcgggagagctcctcctccggccgtcgagcctggcttgcgtgcacagggtgaaccaggtggcgcagcagcactgggacatgttcgcgagcgacacgttccagggcgacctccctggccacctcatggcgtacccgatcgttgtgggcgacgaaggcaagatcacggggatgacgacgcagttcccggacaccaaggccaaggtgctcggcagcaagtccaacgtcctcccgcccatcctcaccacataatttaatgatgatttgatgcaccgtgaactgcagcctggggtgaaatgttgttcattgttgatgtatatgtgcaagcaaagtgtgtgactggtattgcaactggtgtgtgtgagtaaaagatgtggattgcaatttatatgtgaatggaataaagcacaaatgtgatttctattcttcc

SEQ ID NO: 285 - DNA, 3538 bp, Zea mays
tttttttttcacaaaccagttcctaaaaattggagataggaactgaattattaaaaactacgttgcttccaaacaggaccttactaggttatttatttattaaaaacttgctccaataatagactaccatttattatacaaaggttgaaattacagtagcactacattttatggaaatgtgatgtttaaaaataaagagtgcttttaacaataaatatattagcaccaatgtctcattgacatttttattattcatgtatattcatcctgatgatacgagccgagaaagtttggctggttgaaacaggaccgatcatgtaaactactttcaatatgccattcatagggcgacaccacgaccacgtagtacctcccttgtgcacgggcaccagggcgtgtatcaagaattccctttaacttgatgcatatatatccatcatatactacaagaaaattcacaaagttcacaagaattctccaaatcttttgaacttgtctgcaatcaggctttggtgatgaagaagatgttctcatggatcaggaaggtggccttctgcagatgccaggtttccccccatcctcgatcttttgaactagtctactacacacctgccatccttgccgtagcgcacgtacatgagccgtatgcgttttgggcgcagcggcagctggagaatgccgtcggcctcggcacggacggcaagttatacgcgacggtggacatcgacaaggctcgcgtggggcggacgcgcatggtgccccccgtcaactcccccaagtgggacgagtccttccgcatctactgcgcgcacgacgccagcgacatcatcttcaccgtcaaggccgacaacgccatcggcgccacgctcatcggccgcgcctacctgcccacggatagcgtcgtcgccggcaacaaggtgaacctgtggctccccatccgcgacgagaagcgccagccgctggaaggtggtgaccagatacacgtccagctccagttcaccgacgtcgccgcggacccgaccgccggctggggcgccggggtcggcagcgcggcgtacgacggcgtgccccacaccttcttcaagcagcggcgcggctgccgggtgcggctgtacgaggacgcgcatgtcgccgccgacttctcgccgcgcatccggctcgcggggggcaggttctacgagccgcgccggtgctgggtggacgtgttcgacgcgatcaacagggcccgcaggatggtgtacatcgccgggtggtccgtgaacaccgacgtcgtgctggtgcgcgacccacggaagcaggcggcggcggcgtccgagaaccttggcgagctgctcatccggaaggcaaacgagggcgtcacggtgctgatgctggtgtgggacgaccgcacgtcggtggggctcggccccatcaggcgcgacgggctgatggccacaggcgaccaggacacggcggccttcttccgtggcacgcgcgtgcagtgcgtgctgtgcccgcggaaccccgacaaggaccggagctacgtgcaggatatcgagacggacaccatgttcacgcaccaccagaagacggtgatcgtcgacggcggcggcaggccggcgccgtggtcgccgccgggcctcgtgggcttcctcggcggcatcgacatgtgcgacgggaggtacgacacgcaggaccacccgctgttccgcacgctgggcaccacgcacaacagggacttccaccagcccaacttccccggcgcgtccatcagcaagggcgggccgagggagccgtggcacgacatccactgccgcgtcgagggcccggcggcgtgggacgtgctggagaacttcgagcagaggtggaggaagcagggcaagggcgacaacctcctggtggcgctgaacaaggagtgggcggagcgcgaggcggccccgcggggcgacgccgagtcgtggaacgtgcaggtgttccggtccatcgacggcggcgcggcggcggggttccccgagccctccgcggacgcgccccgggaggccgcggcgctcgggctggtgaccggcaaggaccacgtgatggagcgcagcatccaggacgcgtacatccacgccatccggcgggcgcgggacttcgtgtacatcgagaaccagtacttcctggggagctcctacgcgtggcggcagaacgacggcgtgtcggtggaggacatcaacgcgctgcacctcatccctagggagctgtcgctcaagatcgtcagcaagatcgaggccggtgagcggttcgccgtgtacgtggtggtgcccctgtggccggagggcgtgccggagagcggctccgtgcaggccatcctggactggcagcgccgcaccatggagatgatgtacaaggacgtcctcatggccattcgcgccaagggactccaggccgaccccagggactacctcactttcttctgcctcggcaaccgcgaggcgccatgccccggcgagtacgtgccgccggagcacccggaccccaacaccgactacgagagggcgcagcgggcgaggcgcttcatgatctacgtccacgccaagaccatgatagtggatgacgagtacatcatcgtgggatcggcgaacatcaaccagcgctccatggacggcggccgcgacacggagatcgcgatcggcgcgtaccagccgggctacctggcgatcaggaacacctggggcaggcggcggcggcggcactgggcggcgagggggcaggtccatggcttccgggtctccctgtggaaggagcacctggggcaggcggcggcggcggcactgggcggcgatctcctccgtccgtcgagcctgacctgcgtgcgccggatgaaccaggtggcgaagcagcactgggacatgttcgcgagcgacgcgttccagggcaacctcccgggccacctcatggcgtacccggtcagcgtgctcgacgacggcggcggcaagatcgtggccacgacggaaaccttcccggacaccaacgccaaggtgctcggcatcaagtccgacatcctcccgcccatcctcaccacatgatttaatcagcatcgattattaggaataaaaatgggacggatacagtcgaatacagtgtcatcccgtatcttaccctaatgtatttctctcggatacaagaccaaatatgggtagttaagatttggggcggacacaggacgggaccaggtaataatccggtcgggtaagaaacagataacagatactactcagtactcaggtaagtaccggatagttgtcggataattcgtaccgatgatattaattgtccaaccatccaacaaacacataaattaagcaatacataatcatatatatgatagatcaaatgttagaaagaaaaccgataaaattgacatcatgcagttcaaagttactaatcacaagaacattgtggaaccaacaccacaatattaaaaattcataaaatattctaatttcactcaaaaattgtaaataagttacaaaaactaataaacatttatacgaggataactaaagttctcatatga

SEQ ID NO: 286 - DNA, 1455 bp, Zea mays
tcgatcgagctccagagctaaagcagatagaaagctcagagtgagagagcagcatctgatcgaccaattgttcaccttcgtcatgaggtccacttggttggcatttgccttgtcggcgctcgtcgtcgtctcctcatcagcggcacacgtacacgcctcgccggggaaacttgaggtcggtttctacgagcactcatgcgcacaggccgaggacatcgtgcgcaacgccgtccgccgcggcatcgcccgtgagcccggcgtcggcgcggggctcatccggatgcacttccacgactgcttcgtccggggctgcgacggctccatcctcatcaactccacgccgggcaacctggccgagaaggactccgtggccaacaaccccagcatgcgcggcttcgacgtcatcgacgacgccaaggccgtcctcgaggcgcactgcccgcgcaccgtctcctgcgccgacatcgtcgcgttcgcggcccgtgacagcacctacctcgccggcggcctggactacaaggtcccgtcgggccgccgtgacggccgcgtgtccaaagaggaggaggtgctcgacaacaatgtccccgccccgactgacgaggtcgacgagctcatcgagagcttcaagcgcaaggggctcaacgccgacgacatggtcacgctctccggcgcgcacaccatcggccgctcccactgctcctccttcacgcagcggctctacaacttcagcgggcagctggggcagacagacccgtccctcgaccccgcctacgccgggcacctcaaggcgcggtgcccttggccgtccagcgacgaccagatggatcccacggtggtgccgcttgacccagtcacgccggcgaccttcgacaaccagtactacaagaacgtgctggcgcacaaggtcctgttcatctctgacaacacactgctcgacaatccctggacggccggaatggtccacttcaacgccgcagtcgagaaggcatggcaggtcaagttcgccaaggccatggttaagatgggcaaggtccaggtgctcaccggcgacgagggagagatcagggagaagtgcttcgccgtcaacccacactactagtcaagtttaattatctaattaccccgcgcgtgttatgtttgtttatacgttccatacatcaacattatgtagagtgtttttcgttctcttcaaggctgtgaaatcaaacaagtttatcaagtaaaatggtgttatttgcacaacatgcatgtatatatttagtgatgacacccgatcacaaatatagaagctcttttttcccgcgaccagcactgtgtatgtagtctgtacaacactgagagcatctgatttcaccttaattttaatctaatttgtactaacaaaaaaatattgcttttgagaacagtaactgaattttttttcttgtattgattgaaagttaaactaaaagcccg

SEQ ID NO: 287 - DNA, 1631 bp, Zea mays
agcaactaacatcattttcgatctctaaacaactgtctgctttgcttatcatttgctgctacaacaaagtctgggcaacattattaggtacatgctgacatatatgtactacaaagtccactgacacggttcttgtagcagttgttactcgattgttatcgcgatgcagggattatattgggtcttgcttattattcgttgacccggttcacaaacacggttccaagcacattgtataaatagagagtaacatctaaagcagctcttcatctccaccatctcgatcgagctccagagctaaagcagatagaaagctcagagtgagagagcagcatctgatcgaccaattgttcaccttcgtcatgaggtcgacttggttggcatttgccttgtcggcgctcgtcgtcgtctcctcatcagcggcacacgcacacgcctcgccggggaaacttgaggtcggtttctacgagcactcatgcgcacaggccgaggacatcgtgcgcaacgccgtccgccgcggcatcgcccgtgagcccggcgtcggcgcggggctcatccggatgcacttccacgactgcttcgtccggggctgcgacggctccatcctcatcaactccacgccgggcaacctggccgagaaggactccgtggccaacaaccccagcatgcgcggcttcgacgtcatcgacgacgccaaggccgtcctcgaggcgcactgcccgcgcaccgtctcctgcgccgacatcgtcgcgttcgcggcccgtgacagcacctacctcgccggcggcctggactacaaggtcccgtcgggccgccgtgacggccgcgtgtccaaagaggaggaggtgctcgacaacaatgtccccgccccgactgacgaggtcgacgagctcatcgagagcttcaagcgcaaggggctcaacgccgacgacatggtcacgctctccggcgcgcacaccatcggccgctcccactgctcctccttcacgcagcggctctacaacttcagcgggcagctggggcagacagacccgtccctcgaccccgcctacgccgggcacctcaaggcgcggtgcccttggccgtccagcgacgaccagatggaccccacggtggtgccgcttgacccagtcacgccggcgaccttcgacaaccagtactacaagaacgtgctggcgcacaaggtcctgttcatctctgacaacacactgctcgacaatccctggacggccggaatggtccacttcaacgccgcagtcgagaaggcatggcaggtcaagttcgccaaggccatggttaagatgggcaaggtccaggtgctcaccggcgacgagggagagatcagggagaagtgcttcgccgtcaacccacactactagtcatgtttagccaataagccttgccagggtactaagtttgtttatacgttccatatatacgtcgatattatggagattgttttcttcttcaaggttgtgaaatcaaacacaagtttatcaagtaaaatggtgttatttgcacaacatgcataaatttactgttgttatcctcttacaaatatactagctatttttcccgccatcaacagtgtgtatgtacaacagtaagagtattagcggcttctagcatct

SEQ ID NO: 288 - DNA, 2070 bp, Zea mays
tttgcttatgactctaccttatatgttggaatattgtcttatttgtttaggactctaacttgtctcttctattcaaatgatatttttgccatatttatacttctggagtcctactcatattagaccatctaataatcatgacgacttagggtctgtttggttgggctgtggctgtgaaaaaagctgttgtggactgtgagttgtgaaaaaagttattgtatgttgtaagctattaaaaagctaaaaattatttggtggaaaccactaaaagccgttaaaagtatttcgatatatgttttcacagttccatctgaaagctactaaaagcaggtctaggtgtgttttcagttttgcactgcgagaaagtcagcttttagaaaaagctgctttctggatccagccctttggtttggcttttggcttttagggggcaaattaattgtatgtgtctccatgaattctctgatcaagcaactaacatcattttcgatctctaaacaactatctgctttgcttatcatttgctgctacaacaaagtttgggcaacattattaggtacatgctgacatatatgtactacaaagtctactaacacagttcttgtagcagttgttacttgattgttatcgcgatgcagggattatatcgggtcttgcttattattcgttgacccggttcacaaacacggttccaagcacattgtataaatagagagtaacatctaaagcagctcttcatctcgatcgagctccagagctaaagcagatagaaagctcagagtgagagagcagcatctgatcgacccattgttcaccttcgtcatgaggtcgacttggttggcatttgccttgtcggcgctcgtcgtcgtctcctcatcagcgccacacgcacacgcctcgccgaggacatcgtgcgccacgccgtccgccgcggtatcgcccgtgagcccggcgtaggcgcggggctcatccggatgcacttccacgactgcttcgtccggggctgcgacggctccatcctcatcaactccacgccgggcaacaaggccgagaaggactccgtggccaacaaccccagcatgcgcggcttcgacgtcatcgacgacgccaaggccgtcctcgaggcgcactgcccgcgcaccgtctcctgcgccgacatcgtcgcgttcgcggcccgtgacagcacctacctcgccggcggcctggactacaaggtctcgtctggccgccgtgacggtcgcgtgtccaaagaggaggaggtgctcgacaacaatgtccccgccccgactgacgaggtcgacgagctcatcgagagcttcaagcgcaaggggctcaacgccgacgacatggtcacgctctccggcgcgcacaccatcggccgctcccactgctcctccttcacgcagcgcctctacaacttcagcgggcagctggggcagacggacccgtccctcgaccccgcctacgccgggcacctcaaggcgcggtgcccttggccgtccagcgacgaccagatggatcccacggtggttccgcttgacccagtcacgccggcgaccttcgacaaccagtactacaagaacgtgctggcacacaaggtcctgttcatctccgacaacacactgctcgacaacccatggacggccggaatggtccacttcaacgccgcagtcgagaaggcatggcaggtcaagttcgccaaggccatggttaagatgggcaaggtccaggtgctcaccggtgacgagggagagatcagggagaagtgcttcgccgtcaacccacactactagtcaagtttaattatctaattaccccgcgcgtgttatgtttgtttatacgttccatacttccatatatcaacattatgtagagtgtttttcgttctcttcaaggctttgaaatcaaacaagtttatcaagtaacattctttgtgtttcaagatttctacaacaataggtaccatacatacttgtcgggtaccataattaggggtacccccaacactcctaaactcggctggtaatcaccatcagcacaaactgcagagactgatgggtgcaattcagg

SEQ ID NO: 289 - DNA, 1800 bp, Zea mays
cttgattatttaacaataaatgttcatatttcaatattatgtaattatttatgttgttgtcttatgtttcataaccttcatcctttaattatacatgtcgtgtttatgaaggtatgtccttcataaccttcgtctgaagatcattatattctaagggaaataatgcttagaaggacgaaggacattaacatttaatatttttctggtgtgttgccttgttcttaattcatagcatttgagaacaagtctccaacacatggtattaaagtcgatatatgtatggtacctactgctgtagaaatcttgaaacacaaagaatgttacttgataaacttgtttgatttcacacccttgaagagaacgaaaaacactctacataatgttgatgtatggaacgtataaacaaacataattcgcggggtaattagctaaacttgacgactagtagtgtgggttgacggcgaagcacttctccctgatctctccctcgtcgccggtgagcacctggaccttgcccatcttaaccatggccttggcgaacttgacctgccatgccttctcgactgcggcgttgaagtggaccattccggcagtccatgggttttcgagcagtgtgttgtcggagatgaacaggaccttgtgcgccagcacgttcttgtagtactggttgtcgaaggtcgccggcgtgactgggtcaagcggcaccaccgtggggtccatctggtcgttgctggacggccatgggcagcgcatcttgaggtgctcagcgtaggcagggtcgagggacgggtccgtccgccccagctgcccgctgaagttgtagaggcgctccgtgaacgaggagcagtgggagcgcccgatggtgtgcgcgccagagagcgtgaccatgtcgtcggcgttgagccccttgcgcttgaagctctcgatgagctcgtcgacctcgtcagtcggggcagggacattgttgtcgagcacctcatcctctttggacacgcggccgtcacggcggccagacgggaccttgtagtccaggccgccggcgaggtaggcgctgtcacgggccgcgaacgcgacgatgtcggcgcaggagacggtgcgcgggcagtgcgcctcgaggacggccttggcgtcgtcgacgacgtcgaagccacgcatgctggggttgttggccacggagtccttctcggccttgttgtccggcgtggagttgatgaggatggagccgtcgcagccccggacgaagcagtcgtggaagtgcatgcggatgagccccgcgccgacgccgggctcgcgggctatgccgcggcggacggcgttgcgcacgatgtcctccgcctgtgggcacgagtgctcgtagaaaccgacctcaagtttccccggcggcgaggcgtgtgatgccaccgttgaggaggcggcgaccacgagtgccgccagcacggccgccaaccatgtcgtcgaccccatgatcagctgcagtctcagcaagtttgctgtagtcgcttgagttgaaggcgatggtgatgttgatcgctcagaactgaagctgatgaggagatttgagggatggtgccgccgctgggtctctatttatacattggaggtagcttgcatggcagtatgtcgcaataatcatggcgtgtttgtgcacccagtcaacaaataagacccaatcttcgcgttccctagctaatgtctgctagaccctctctttccatgcaccatccttaaaataaaaacaactccttccgaacaacacagctgcaaaacatgcatcttcttgtccttgttttcgattgccac

SEQ ID NO: 290 - DNA, 2500 bp, Zea mays
ggccagtcagtactgacagcatgcaaaggccacatgctcgggtggtaggggcttcggttgaactaaaggcagagagctatgtgggcttatcgggtcatttgaccctataagatttggcaaatcatatacaatatattgttagctagtgattagtgaagctgacacctagccttagtgataacataattcattttgacacggcttcgatttgtcttggtcatgcggcagcggtatcgaccatgtcaatgaaacttgaaatatatatatatatatatatatatatatatatatatatgatcaagcaagtaatatcattgtccatctctaaacagttgtctgctctgcttatcattacgttgattgatcaaaaataccccctcgtgatagctacataatttacaatcgaaagtgacgcgtgtggcaattcaaaacaaagacaagatgcgtgttttgcagctgttttgttataggaaggacgaaggagttttttttatttttaatgatggtgcatggaaattaagagggtctagcagacattagctagggaacgcgaagattgggtcttatttcttgaccgggtgcacatgacatacacacgccatcctccaactgcgacatgtcgccatgcaagcttccaatgtataaatagagacccagcggcggcaccgttcttcaaatctcctcatcagcttcacttctcaacatcaccatcgacctcgatcaactcaagcgactatagcaaacttgctgagagtttgggtatatacgactgcagttgatcatggggcggtcgacatggctgatgcctgctgccttgctggtggcactcatcgccgccgcctcctcatcggtggcactcgcctcgccgcctgggaaacttgaggtcggtttctacgagcactcgtgcccacaggccgaggatatcgtgcgcaacgccgtccgccgcggcatcgcccgtgagcccggcgtaggcgcggggctgcgacggctccatcctcatcaactccacgccgggcaacaaggccgagaaggactcagtggccaacaaccccagcatccatgcgcggcttcgacgtcatcgacgacgccaaggccgtcctcgaggcgcactgcccgcgcaccgtctcctgcgccgacatcgtcgcgctcgcggcccgtgacagcacctacctcgccggcggcctggactacaaggtcccgtctggccgccgtgatggccgcgtgtccaaagaggaggaggtgctcgacaacaatgtcccagctccgactgacgaggtcgacgagctcatcgagagcttcaagcgcaaggggctcaacgccgacgacatggtcacgctctctggcgcgcacaccatcggccgctcccactgctcctccttcacgcagcgcctacaacttcagcgggcagctggggcagacagacccgtccctcgaccccgcctacgccgggcacctaaaggcacggtgcccttggccgtccagcgacgaccagatggaccccacggtggtgccgcttgacccagtcacgccggcgaccttcgacaaccagtactacaagaacgtgctggcgcacaaggtcctgttcatctccgacaacacactgctcgacaacccatggacggccggaatggtccacttcaacgccgcagtcgagaaggcatggcaggtcaagttcgccaaggccatggttaagatgggcaaggtccaggtgctcaccggcgacgagggagagatcagggagaagtgcttcgccgtaaacccacactactagtcaagtttaattatctaattaccccgcgcgtgttatgtttgtttatacgttccatacatcaacattaagtagagtgttttttgttctcttcaaggctgtgaaatcaaacaagtttatcaagtaaaatggtgttatttgcacaacatgcatgtacatatttagtgaccacatccgatcacaaatatagaagctctttttttcccgcgagcactgtgtatgtagtctgtacaacactgagagttttatgtagaaatattttcattatcatagtggatcttcgaaaaaacagactttgtatcgactaaaatatatattttgactttcatatgctagaactttagctcgtaaacataaaagtacggtacgaacttttatgcaacgattgggttcggtatttttagaagaattttttacgaaagaagagcaagctttttctttgatgttcaccaaaacaattcacttttctttccagggagaagtgcttttgagaactgcaactgaattttttgtacttgtatttattgaaagttagactaaaagaccgcatctgacactaaaagcccgcaaatttaccgattgcactgactggtactatagatagtacttcagtaccggttcttggttagaaccgttactaaaggtcccctattagtatcggttcttggctagagccgtactaaagttgaaactttagcaccggttgtaatcatgaactggtactaaagtcca

SEQ ID NO: 291 - DNA, 1351 bp, Sorghum bicolor
cttcatctcttactcaccatctcgaattctcaatcgaggtccaaagctaaagccgctagcaagctcagagtgagagtggcatctgatcgaccaatatatagctcattgttcaccatcgccatgaggttgacgtggttagcaattgcctttgccttggcggcgctcgtcgtcgtctcctcatcggcggcacgcgcacaggcctcaccggcggaactggaggtcggtttctacaagcactcatgcccaaaggccgagtccatcgtgcgcaacgccgtccgccgcggtatcgcccgtgacgccggcgtcggcgccggactcatccggatgcacttccacgactgcttcgtccggggctgcgacgcctccatcctcatcaactccacgccgcgcaacaaggccgagaaggactccgtcgccaacaaccccagcatgcgcggcttcgacgtcgtcgacgacgccaaggccgtcctcgaggcgcactgcccgcgcaccgtctcctgcgccgacatcatcgcgttcgccgcccgcgacggcgcctacctcgccggcggcctcgactacaaggtcccctcgggccgccgtgacggccgcgtgtccaaagaggacgaggtgctcgacaacaatgtccccgccccatttgacgacgtagccgagctcatcaagagcttcaagcgcaagggcctcaacgccgacgacatggtcacgctctccggcgcgcacaccattggccgctctcactgctcctccttcacgcagcgcctttacaacttcagcggccagctcgggcggactgacccgtcgcttgaccccacctacgctgagcacctcaagatgcgctgcccatggccgtccagcaacggccagatggaccccacggtggtgccgctcgacccggtcacgccggcgaccttcgacaaccagtactacaagaacgtgctggcgcacaagggcctgttcgtctccgacaacacgctgctcgacaacccctggacggccggaatggtccacttcaacgccgcagtcgagaaggcatggcaggtcaagttcgccaaggccatggtgaagatgggcaaggtccaggtgctcaccggcgacgagggagagataagggagaagtgcttcgtcgtcaacccacactactagtcaagtttagctaattaccacgtgtactatgtttgtttgtttatttatacgttccacacgtcaatacgtcatgagtttgagattgttttctcttcaagtctgtgaatgaaatcaaacacaagtttgtcaagtaaaattgtgtaatttgcacagcatgaaagaaatttagtgatgacatcctcttatagaaatgtagaagctatttttt

SEQ ID NO: 292 - DNA, 1356 bp, Sorghum bicolor
atctcctcatcaacagcttcaattctcagcgatcgccatcgacctcgacctcgacctcagctcaagctactatagcaaacctgcagagagatacgataggactgcaggcgatcatggtgtcgacatggctggcaacagtcttggcggcgctcgtcgtcgccacggcggcacacgcggcggcggaactggaggtcggtttctacaagcactcgtgcccaaaggccgaggagatcgtgcgcaacgccgtccgccgcggtatcgcccgtgacgccggcgtcggcgccggactcatccggatgcagttccatgactgcttcgtccggggctgcgacgcctccatcctcatcaactccacgccgggcaacaaggccgagaaggactccgtcgccaacaaccccagcatgcgcggcttcgacgtcgtcgacgacgccaaggccgtcctcgaggcgcactgcccgcgcaccgtctcctgcgccgacatcatcgcgttcgccgcccgcgacggcgcctacctcgccggcggcctcgactacaaggtcccctcgggccgccgtgacggccgcgtgtccaaagaggacgaggtgctcgacaacaatgtccccgccccgtttgacgacgtcgccgagctcatcaagagcttcaagcgcaagggtctcaacgccgacgacatggtcacgctctccggcgcgcacaccattggccgctctcactgctcctccttcacgcagcgcctttacaacttcagcggccagctcgggcggactgacccgtcgcttgaccccacctacgctgagcacctcaagatgcgctgcccatggccgtccagcaacggccagatggacaccacggtggtgccgctcgacccggtcacgccggcgaccttcgacaaccagtactacaagaacgtgctggcgcacaaggtcctgttcgtctccgacaacacgctgctcgacaacccctggacggccggaatggtccacttcaacgccgcagtcgagaaagcatggcaggtcaagttcgccaaggccatggtgaagatgggcaaggtccaggtgctcaccggcgacgagggagagatcagggagaagtgcttcgtcgtcaacccacactactagtcaagtttagctaattaccttgtgtactatgtttgtttatttatttatacgttccacacgtcaatacgtcataagtttgagaatgttttctcttcaagtctgtgaatgaaatcaaacacaagtttgtcaagtaaaattgtgtaatttgcacagcatgaaagaaatttagtgatgacatcctcttatagaaatgtagaagctattttttcccccgcaatcagcagtgtgtctgtacaaaacc

SEQ ID NO: 293 - DNA, 2837 bp, Sorghum bicolor
accacacacgtccacaccactcctccccggtgccggcctctcaattgatggcgccaatttacctgacggacgtcgtcgtcgtcctcttcttgtcgttggtgtctcagttctggtgtcactgccaccatgtatttcttttttccccgtagactagagactgccgatggatcggaagcgcgcgaaggcgaaggcgcgaagcacggcactcagatctgcatgcaggacactgcttgctcagctctctgcaaaagggttgtaattagacaagacaagattcgtcgtccgctcgttaattagctggtggtcaaaactacaggcctcgccgcttcaatcgaatgccatattgccatgttccttccttcttccagatgacacactactggctgcctgctggcctgttgggtggttggccatgcccatgttattcctagctaggctcctagctagctatgtgttcttcaccagtgagcagtgactcagtatacatataggagtttctctgcacataaatacatatattctggatcgatccatcgtgtcgatctgtatatatacaaaaggttcctcgatccttcttccttactactccaccttagctagctactgcttccatctgtcagtatacagtgtagtccggccgctcacaagctacccagctagctagctgtgtgccggccggcggtgctctcatctctatccatcatattcatagggtagccggtacagtggtaggctagcagggacgacgatgagcgccggcaccagagctgatgaggtcgtcgtccaagtacggcagctcgtcgtcgtagtggctgtcgccgtgatggcgacatcatgcttctcctcctcggaggcgcagctccaggtcgggtactacaacgccacctgccccgccgccgagagcctcatcgagaccatcgtccacgccgccgtccgtaaggacgccggcaacggccccggcctcatccgcctcttcttccacgactgcttcgtcaggggatgcgacgcgtcggtgctgctagacgacccgacgggcacgccagggaacaggacggtggagaagacgtcgcaaccaaacttccccagcctccgtgggttcagcgtcatcaaccgggcgaaacgcgtggtggagcggcggtgcccggggacagtctcgtgcgccgacatcgtcgccttcgcggcgcgcgacgccgcccggatcatgggcgggatccgcttcgccatgccttccggccgcctcgacgggcgcgtctccaacgcgtccgaggcgacggccaaccttccgccggcgtcgttcaacctgacgcagctcctggcccggttcgcgtccaagaacctcaccgccgacgacctcgtcacgctgtcgggcgcccactccatcggccgctcccactgctcctccttcgccaacacgcggctgtacccgcagctggacgccacgctgaacgtcacgctggcggcgaggctcagggccaagtgccccgccgctcccggcgggaaagaccgcgtcgtcgacctcgatttcaggacgccgctgcagctggacaaccagtactacagcaacgtggcgacgcatgaggtggtgttcgggtccgaccaggcgctcggcgaccggaacgacacggcggcgctcgtcgcgctgtatgctgccaaccgtaagatatggtcgcagaagttcgccgcggccatggtgaagatgggtagcatcgaggtgctcaccggcccccccggcgaggtcaggctcaagtgcaacaagcgatcgccatcgacctcgacctcgacctcagctcaagctactatagcaaacctgcagagagatacgataggactgcaggcgatcatggtgtcgacatggctggcaacagtcttggcggcgctcgtcgtcgccacggcggcacacgcggcggcggaactggaggtcggtttctacaagcactcgtgcccaaaggccgaggagatcgtgcgcaacgccgtccgccgcggtatcgcccgtgacgccggcgtcggcgccggactcatccggatgcagttccatgactgcttcgtccggggctgcgacgcctccatcctcatcaactccacgccgggcaacaaggccgagaaggactccgtcgccaacaaccccagcatgcgcggcttcgacgtcgtcgacgacgccaaggccgtcctcgaggcgcactgcccgcgcaccgtctcctgcgccgacatcatcgcgttcgccgcccgcgacggcgcctacctcgccggcggcctcgactacaaggtcccctcgggccgccgtgacggccgcgtgtccaaagaggacgaggtgctcgacaacaatgtccccgccccgtttgacgacgtcgccgagctcatcaagagcttcaagcgcaagggtctcaacgccgacgacatggtcacgctctccggcgcgcacaccattggccgctctcactgctcctccttcacgcagcgcctttacaacttcagcggccagctcgggcggactgacccgtcgcttgaccccacctacgctgagcacctcaagatgcgctgcccatggccgtccagcaacggccagatggacaccacggtggtgccgctcgacccggtcacgccggcgaccttcgacaaccagtactacaagaacgtgctggcgcacaaggtcctgttcgtctccgacaacacgctgctcgacaacccctggacggccggaatggtccacttcaacgccgcagtcgagaaagcatggcaggtcaagttcgccaaggccatggtgaagatgggcaaggtccaggtgctcaccggcgacgagggagagatcagggagaagtgcttcgtcgtcaacccacact

SEQ ID NO: 294 - DNA, 1522 bp, Zea mays
cacatatgttgactgggtacacaaacacagtgacacgcacacacgctatccccccaactgctgcacatttgcactcttcgcctgtataagatacagacccagccgcgcaaatctttcatcccctcaactctacgtctctctctacctactctcggtcaccacacctcgctcgaaaacaaaactgatcaacagcattgttggtgacgatgagctcgacgtggctggcgtttgcatgggcggcggccgccctcgtcgtggcggcgtccacggcgcacgccccgcaccacccgtcgtcgctgcaggtcggtttctacaagcactcgtgcccacaggccgaggacatcgtgcgcaacgccgtccgccgcggtctggtccgcgacccgggcgttggcgcgggactcatccgcatgcacttccacgactgcttcgtccggggctgcgacgcctcaatcctcatcaactccacgccgggcaacctagccgagaaggactccgtggccaacaaccccagcatgcgcggcttcgacgtcatcgacgacgccaaggccgccctcgaggcgcactgcccgcgcaccgtctcctgcgccgacatcgtcgcgttcgcggcccgcgacagcgcctgctccgccggcggcctcgagtacgaggtcccctcggggcgccgcgacggccgagtttccagacaagacgaggtgctcgacaacaatgtccccacaccgaccgacgtcgtcgccgagctcatcgagagcttcaagcgcaaggggctgtccgccgacgacatggtcacgctctccggcgcgcacaccatcggccgctcccactgctcctccttcacgcagcggctatacaacttcagcgggcagctggggtggacggacccgtccctcgaccccgcctacgccgggcacctcaaggcgcggtgcccttggccgtccagcgacgaccagatggaccccacggtggtgccgcaggacccagtcacgccggcgaccttcgacaaccagtacttcaagaacgtgcttgcgcacaaggtcctgttcgtctccgacaacacgctgctcgacaacccctggacggccgggatcgtccaatttaacgccgcagtcgagaaggcgtggcaggtcaggttcgccaaggccatggtcaagatgggcaaggtgcaggtgctcaccggcgatgagggagagatcagggaaaagtgcttcgtcgtcaacccacactactagctattgcaactacatacttcgagagactacctatagagctaaaaatagagattttgaagagagagaaaaaaaagtactctcgcgagtgcaaataagactcttgtagacgctcgtattactctccgtggaaatctctagccagaaatcattaatataataaaggacaagtggcacgtctatcaccgcatcagttatgtgtttgtgaattacaaaattattgcattgttctaaattataaattgttttacctttctctacctaataagataagagtatctacaaaagtctttctgaaa

SEQ ID NO: 295 - DNA, 1795 bp, Zea mays
ctttagagtatgcacgagataaagaaaaactgttagagagtgaagatatgtagaaaatcaattttataaaaatgactctaccaatgatgatgatgattcggagagagatttcagaaagacttttgtagatactcttatcttattaggtagagaaaggtaaaacaatttataatttagaacaatgcaataattttgtaattcacaaacacataactgatgcggtgatagacgtgccacttgtcctttattatattaatgatttctggctagagatttccacggagagtaatacgagcgtctacaagagtcttatttgcactcgcgagagtacttttttttctctctcttcaaaatctctatttttagctctataggtagtctctcgaagtatgtagttgcaatagctagtagtgtgggttgacgacgaagcacttttccctgatctctccctcatcgccggtgagcacctgcaccttgcccatcttgaccatggccttggcgaacctgacctgccacgccttctcgactgcggcgttaaattggacgatcccggccgtccaggggttgtcgagcagcgtgttgtcggagacgaacaggaccttgtgcgcaagcacgttcttgaagtactggttgtcgaaggtcgccggcgtgactgggtcctgcggcaccaccgtggggtccatctggtcgtcgctggacggccaagggcaccgcgccttgaggtgcccggcgtaggcggggtcgagggacgggtccgtccaccccagctgcccgctgaagttgtagagccgctgcgtgaaggaggagcagtgggagcggccgatggtgtgcgcgccggagagcgtgaccatgtcgtcggcggacagccccttgcgcttgaagctctcgatgagctcggcgacgtcgtcggttggtgtggggacattgttgtcgagcacctcgtcttgtctggaaactcggccgtcgcggcgccccgaggggacctcgtactcgaggccgccggcggagcaggcgctgtcgcgggccgcgaacgcgacgatgtcggcgcaggagacggtgcgcgggcagtgcgcctcgagggcggccttggcgtcgtcgatgacgtcgaagccgcgcatgctggggttgttggccacggagtccttctcggctaggttgcccggcgtggagttgatgaggattgaggcgtcgcagccccggacgaagcagtcgtggaagtgcatgcggatgagtcccgcgccaacgcccgggtcgcggaccagaccgcggcggacggcgttgcgcacgatgtcctcggcctgtgggcacgagtgcttgtagaaaccgacctgcagcgacgacgggtggtgcggggcgtgcgccgtggccgccgccacgacgagggcggccgccgcccatgcaaaagctagccacgtcgagctcatcgtcaccaacaatgctgttgatcagttttgttttcgagcgaggtgtggtgaccgagagtaggtagagagagacgtagagttgaggggatgaaagatttgcgcggctgggtctgtatttattatacaggcgaagagtgcaaatgtgcagcagttggggggatagcgtgtgtgcatgtcactgtgtttgtgtacccagtcaacatatgtgaagaccctaaatccttttgccatgcatagacagcttttgtcttgttcaaactaatataatcccacggaaacgtaggtgaatgttagcttatttttccaataggtacaacgaaatccggctctttataccaagtagcttgttgaatgttttttcgagcgctcgg

SEQ ID NO: 296 - DNA, 1169 bp, Saccharum officinarum
tgtcttgatcgatcaccatctcggtcgagaacaaagttgaatcaccaacaatccacggttggtgtcttggttggtgacgatgaggtcgacgtggctggcttttgcatgggcggcggccctcgtcgtggcggcgtccacgacggcgcacgcctcgcaccacgcgtcgctggaggtcggcttctacaagcagtcgtgcccacaggccgaggagatcgtgcgcaacgccgtccgccgcggcgtcgcccgcgaccccggcgtgggcgcggggctgatccggatgcacttccacgactgcttcgtccggggctgtgacggctccatcctcatcaactccacgccgggaaacaaggccgagaaggactccgtggccaacaaccccagcatgcgcggcttcgacgtcgtcgacgacgccaaggccgtcctcgaggcgcactgcccgcgcaccgtctcctgcgccgacatcgtcgcgttcgcagcccgcgacggcgcctacctcgacggcgggatcgactacaaagtcccctcagggcgccgcgacgggcacgtgtccagagaagaggaggtgctcgacgacaatgtccccaccccgactgacgacgtcgccgagctcatcgcgagcttcgagcgcaaggggctctccggcgaagacatgggcacgctttccggcgcgcacaccatcggccgctcccactgctcctccttcacgcagcgcctctacaacttcagcgggcagctggggcggacggacccgtccctcgaccccgcttacgccgagcacctcaagatgcggtgcccgtggccgtccagcgatgagcagatggaccccacggtggtgccgcaagaccctgtgacgccggccaccttcgacaaccagtacttcaagaacgtgctggcgcacaagggcttgttcatctccgacaagacactgctcgataacccttggacggctgggatcgtccacttcaacgccgcagtcgagaaggcgtggcaggtcaagttcgccaaggccatggtcaagatgggcaaagtccaggtgctcaccggcgatgagggagagatcagggaaaagtgcttcgtcgtgaacccacactactaattactataagcggaaatctagctagcagttattccactataatataataaacgacaaatttggagtggcagtc

SEQ ID NO: 297 - DNA, 1575 bp, Zea mays
ttcaactttagtacggctctagccaagaaccgatactaataggggacctttagtaacggttctaaccaagaaccggtactgaagtactatctatagtaccagtcagtgcaatcggtaaatttgcgggcttttagtgtcagatgcggtcttttagtctaactttcaataaatacaagtacaaaaaattcagttgcagttctcaaaagcacttctccctggaaagaaaagtgaattgttttggtgaacatcaaagaaaaagcttgctcttctttcgtaaaaaattcttctaaaaataccgaacccaatcgttgcataaaagtttgtaccgcacttttatgtttacgagctaaagttctagcatatgaaagtcaaaatatatattttagtcgatacaaagtctgttttttcgaagatccactatgataatgaaaatatttctacataaaactctcagtgttgtacagactacatacacagtgctcgcgggaaaaaaagagcttctatatttgtgatcggatgtggtcactaaatatgtacatgcatgttgtgcaaataacaccattttacttgataaacttgtttgatttcacagccttgaagagaacaaaaaacactctacttaatgttgatgtatggaacgtataaacaaacataacacgcgcggggtaattagataattaaacttgactagtagtgtgggtttacggcgaagcacttctccctgatctctccctcgtcgccggtgagcacctggaccttgcccatcttaaccatggccttggcgaacttgacctgccatgccttctcgactgcggcgttgaagtggaccattccggccgtccatgggttgtcgagcagtgtgttgtcggagatgaacaggaccttgtgcgccagcacgttcttgtagtactggttgtcgaaggtcgccggcgtgactgggtcaagcggcaccaccgtggggtccatctggtcgtcgctggacggccaagggcaccgtgcctttaggtgcccggcgtaggcggggtcgagggacgggtctgtctgccccagctgcccgctgaagttgtaggcgctgcgtgaaggaggagcagtgggagcggccgatggtgtgcgcgccagagagcgtgaccatgtcgtcggcgttgagccccttgcgcttgaagctctcgatgagctcgtcgacctcgtcagtcggagctgggacattgttgtcgagcacctcctcctctttggacacgcggccatcacggcggccagacgggaccttgtagtccaggccgccggcgaggtaggtgctgtcacgggccgcgaacgcgacgatgtcggcgcaggagacggtgcgcgggcagtgcgcctcgaggacggccttggcgtcgtcgatgacgtcgaagccgcgcatggatgctggggttgttggccactgagtccttctcggccttgttgcccggcgtggagttgatgaggatggagccgtcgcagccccgcgcctacgccgggctcacgggcgatgccgcggcggacggcgttgcgcacgatatcctcggcctgtgggcacgagtgctcgtagaaaccgac

SEQ ID NO: 298 - DNA, 1322 bp, Setaria italica
cttcatctcctcatcagccagcttcaatcctcaatcaccactgcagagagttaaggaggagtaagacatcagtgcgctagcacttgatagctagaccaatccattgtagaacgtgatgaggtcgacgtggctgccatttgccatggcggcgctcgtcctcgcctcggtgtcggcacacgcctcgcacctggaggtcgggttctacaagcactcgtgcccggaggcggaggagatcgttcggaacgccgtccgccgggggcttgcccgtgaccccggcgtcggcgccggcctcatccggatgcacttccacgactgcttcgtccgcggttgcgacggctccatcctcatcaactcgacgccgggcaaccgggccgagaaggactccgtcgccaacaaccccagcatgcgcggcttcgacgtcatcgacgacgccaaggccgtcctcgaggcgcactgcccgcgcaccgtctcctgcgccgacgtcgtcgccttcgcggcgcgcgacggcgcctacctcgccggcggcatcgagtaccaggtcccctcgggccgccgcgacggccgcgtctccatcgaagccgaggtgctcaacaacaacgtccccgcccccaccgaccgcctccgcgagctcatcgagagcttcaagcgcaagggcctctccgccgacgacatggtcacgctctccggcgcgcacaccatcgggcgctcccactgctcctccttcacgcagcgcctctacaacttcagcggccaattgggcaagaccgacccctccatcgaccccgcctacgccgaacacctcaagatgcggtgcccgtggccgtccagcgacgaccagatggaccccaccgtggtgccgctcgaccccgtcacgccggcgagcttcgacaaccagtacttcaagaacgtgctcgcgcacaaggtcgtgctcacctccgaccagacgctgctcgacagcccgtggacggccgggatcgtcaagttcaactccgccgtcgagaaggcgtggcagctcaagttcgccgcctccatgatcaagatgggcaagatcgaggtgctcaccggcgacgagggggagatcagggagaagtgcttcgtcgtcaacccacactactagtcaccgtgccatcgctagaactacaccagtttgcgtgtgccacttctatccatcatccaaattgattcattttcttatcaaaattttgtgtaatatcgttgatcgtgtttgtcaaacagtaatttttgttgggcacctcgttctatcagtttaaaggaattcccagtttaaatgtacattgttaacaaattgcttttcgtggccc

SEQ ID NO: 299 - DNA, 1280 bp, Setaria italica
cttcatctcctcatcagcttccattctcgatcaccttcgccatcgagctcaacaaacctagatagcaaacttgatttgcagatagttgacgataggaccaatccattgtagatcatgacgaggtccacttggttgccgtttgccatggcggcgctcgtggtcgcctcggtggcgcacgcctcgccgccggcgaaactgaaggtcgggttctacaagcactcgtgcccggaggcggaggagatcgtgcgcaacgccgtccgccgcggcctcgcccgtgaccccggcgtcggtgccggcctcatccgcatgcacttccacgactgcttcgtccgcggctgcgactcctccatcctcatcaactcgacgccgggcaaccgggctgagaaggactccgtcgccaacaaccccagcatgcggggcttcgacgtcatcgacgacgccaaggccgtcctcgaggcgcactgcccgcgcaccgtctcctgcgccgacgtcgtcgccttcgctgcgcgcgacggcgcctacctcgccggcggcatcgagtaccaggtcccctcgggccgccgcgacggccgcgtctccatcgaagccgaggtgctcaacaacaacgtccccgcccccaccgaccgcctccgcgagctcatcgagagcttcaagcgcaagggcctctccgccgacgacatggtcacgctctccggcgcgcacaccatcgggcgctcccactgctcctccttcacgcagcgcctctacaacttcagcggccaattgggcaagaccgacccctccatcgaccccgcctacgccgagcacctcaagaagcggtgcccgtggccgtccagcgacgaccagatggaccccaccgtggtgccgctcgaccccgtcacgccggcgagcttcgacaaccagtacttcaagaacgtgctctcgcacaaggtcgtgctcacctccgaccagacgctgctcgacagcccgtggacggccgggatcgtcaagttcaactccgccgtcgagaaggcgtggcagctcaagttcgccgcctccatgatcaagatgggcaagatcgaggtgctcaccggcgacgagggggagatcagggagaagtgcttcgtcgtcaacccacactactagttactatagcttagccattactatacacagatttggagtgactcgtcgatcgccacacttttaaatttgttcttttttacctatcgtaatcaaaattatgtgttttgtgattgtgaagtatttttttggtcaacgtctcaacgaattatacccgt

SEQ ID NO: 300 - DNA, 1274 bp, Zea mays
gcgcaacgccgtccgccgcggcatcgcccgtgagcccggcgtaggcgcggggctgcgacggctccatcctcatcaactccacgccgggcaacaaggccgagaaggactcagtggccaacaaccccagcatccatgcgcggcttcgacgtcatcgacgacgccaaggccgtcctcgaggcgcactgcccgcgcaccgtctcctgcgctgatatcgtcgcgctcgcggcccgtgacagcacctacctcgccggcggcctggactacaaggtcccgtctggccgccgtgacggccgcgtgtccaaagaggaggaggtgctcgacaacaatgtcccagccccgactgacgaggtcgacgagctcatcgagagcttcaagcgcaaggggctcaacgccgacgacatggtcacgctctctggcgcgcacaccatcggccgctcccactgctcctccttcacgcagcgcctctacaacttcagcgggcagctggggcagacagacccgtccctcgaccccgcctacgccgggcacctaaaggcgcggtgcccttggccgtccagcgacgaccagatggaccccacggtggtgccgcttgacccagtcacgccggcgaccttcgacaaccagtactacaagaacgtgctggcgcacaaggtcctgttcatctccgacaacacactgctcgacaacccatggacggccggaatggtccacttcaacgccgcagtcgagaaggcatggcaggtcaagttcgccaaggccatggttaagatgggcaaggtccaggtgctcaccggcgacgagggagagatcagggagaagtgcttcgccgtcaacccacactactagtcaagtttaattatctaattaccccgcgcctgttatgtttgtttatacgttccatacatcaacattatgtagagtgtttttcgttctcttcaaggctgtgaaatcaaacaagtttatcaagtaaaatggtgttatttgcacaacatgcatgtatatatttagtgatgacacccgatcacaaatatagaagatcttttttcccgcgaccagcactgtgtatgtagtctgtacaacactgagagcatctgatttcaccttaattttgatctaatttgtactaacaaaaaatatttcttttgagaactgcaactgaattttttttacttgtattgatcgaaagttaaactaaaagcccgcatctgacactaaaagcccgcaactttaccggttgcactggctggtactaaagatagtactccagtaccgat

SEQ ID NO: 301 - DNA, 1338 bp, Sorghum bicolor
ctgctacacataatgccactctagagctctctagcttctcttgtataaatacacaccttcgtctcctcaacagacaactacctctactctccatcaacaatccactgttgctgacgatgagccgctcgacatggctggcttttgcatgggcggcggccctcgtcgtcgtcgtcgtggcggcgtccacgacgacgacggcacacgcctcgcaccacgcgtcgctggaggtcggtttctacaagcactcgtgcccagaggccgagtccatcgtgcgcgacgccgtccgccgcggcgtcgcccgcgacgccggcgtcggcgcggggctcatccggatgcagttccacgactgcttcgtccggggctgcgacgcctccatcctcatcaactccacgccgggcaacaaagccgagaaggactccgtcgccaacaaccccagcatgcgcggcttcgacgtcgtcgacgacgccaaggccgtcctcgaggcgcactgcccgcgcaccgtctcctgcgccgacatcgtcgcgttcgccgcccgcgacggcgcctacctcgccggcggcctcgactacaaggtcccctcgggacgccgcgacggccgcgtgtccagagaagacgaggtgctcgacagcaacgtccccgcaccgttcgacgacgtcgccgagctcatccagagcttcaagcgcaagggcctcaccgccgacgacatggtcacgctctccggcgcgcacaccatcggccgctcccactgctcctccttcacgcagcggctctacaacttcagcgggcaactggggcggacggacccgtcgctcgacgtcgcctacgccgaccacctcaagatgcggtgcccatggccgtccagcgacggcaagaggcaccccgcggtggtgccgcaggaccctgtcacgccggcgaccttcgacaaccagtacttcaagaacgtggtggcgcacaagggcctgttcgtctccgacaagacgctgctcgacagcacctgcacggctgggatcgtccacttcaacgccgcagtcgacaaggcatggcaggtcaagttcgccaaggccatggtgaagatgggcaagatccaggtgctcaccggcgatgagggagagatcagggagaagtgcttcgtcgtcaacccacactagttacttactatatataagtggaaatgtagtagctaacagtcagtgctgtaataaaggacaaatttggagtggcacgtcgatcaccgcacttgcgtgtttgcgaagtagtactgctctgttccagtttcacaaaacaaaacaaaaaaaacctcggttttgttttttctactctagacataacgtatattta

SEQ ID NO: 302 - DNA, 1228 bp, Echinochloa colona
acctcctcatcaccatcatcttcagttctcgatcataattgcgatccagctcaaccgagattgtaaacgaaattgatttccagagagccaagagcaagactgcagggcgctaccacttggttgaccatgatgaagccgacatggttggcgtttgccatggcggcgctcgtcgtcgtcgccacggcggcacacgcctcgcatctggaggtcggcttctacaagcactcgtgcccgcaggccgaggagatcgtgcgcaacgccgtccgccgcgccatcgcccgtgaacccggcctcggcgccgggctcatccggatgcacttccacgactgcttcgtccgcggctgcgacggctccatcctcatcaactccattcccggccagccgatggcggagaaggactctgtcgccaacaaccccagcatgcgcggcttcgacgtcatcgacgacgccaaggccgccctcgaggcgcactgcccacgcaccgtctcctgcgccgacgtcgtcgccttcgcggcgcgcgacggcgcctacctcgccggcggcatcgactaccaggtcccctcgggccgccgcgacggtcgcgtctccctctccagcgaggtgctcaacaacaacgtccccggcccgaccttccacgtcgacaagctcgtcgagagcttcaagcgcaagggcctctccgccgacgacatggtcacgctctccggcgcgcacaccatcgggcgctcccactgctcctccttcacgcagcgcctctacaacttcagcggccagctggggaagacggatccctccatcgacgccgcctacgccgagcacctcaaggcgcggtgcccatggccgtccagcaacggccagatggaccccaccgtggtgccgctcgaccccgtcacgccggcgagcttcgacaaccagtacttcaagaacgtgctggcgcacgaggtcgtgctcacctccgaccagacgctgctcaagaaccggtggacggccgggatcgtcaagttccatgccgcagtcgagaaggcgtgggaaatcaagttcgccgcggccatgatcaagatgggcaagatcgaggtgctcactggcaacgagggggagatcagggagaaatgcttcgtcgtcaacccacactactagtcactttaattaatttattagccagtattaagattgtttatatgttgcactttaattataatcgtcgagatcttttgtcccttttcatcctgtg

SEQ ID NO: 303 - DNA, 1237 bp, Echinochloa colona
acctcctcatcaccatcatcttcagttctcgatcataattgcgatccagctcaaccgagattgtaaacgaaattgatttccagagagccaagagcaagactgcagggcgctaccacttggttgaccatgatgaagccgacatggttggcgtttgccatggcggcgctcgtcgtcgtcgccacggcggcgcacgcctcgcacctggaggtcggcttctacaagcactcgtgcccgcaggccgaggagatcgtgcgcaacgccgtccgccgcgccatcgcccgtgaacccggcctcggcgccgggctcatccggatgcacttccacgactgcttcgtccgcggctgcgacggctccatcctgatcaactccatccccggccagccggcggcggagaaggactccgtcgccaacaaccccagcatgcgcggcttcggcgtcatcgacgacgccaaggccgccctcgaggcgcactgcccacgcaccgtctcctgcgccgacgtcgtcgccttcgcggcgcgcgacggcgcctacctcgccggcggcatcgactaccaggtcccctcgggccgccgcgacggtcgcgtctccctctccagcgaggtgctcaacaacaacgtccccggcccgaccttccacgtcgacaagctcgtcgagagcttcaagcgcaagggcctctccgccgacgacatggtcacgctctccggcgcccacaccatcgggcgctcgcactgctcctccttcacgcagcgcctctacaacttcagcggccagctggggaagacggacccctccatcgacgccgcctacgccgagcacctcaaggcgcggtgcccatggccgtccagcaacggccagatggaccccaccgtggtgccgctcgaccctgtcacgccggcgagctttgacaaccagtacttcaagaacgtgctggcgcacaaggtcgtgctcacctccgaccagacgctgctcaagaaccgctggacggccgggatcgtcaagttccacgccgctgtcgagaaggcgtgggagatcaagttcgccgcgtccatgatcaagatgggtcaaatcgaggtgctcaccggtaacgagggggagatcagggagaaatgcttcgtcgtcaacccgcactactagtcaattcaactaattattagccagtattaagattgtttatatgttgcactttaattataatcgtcgagatcttttgtcccttttcatcctgtgtaattgatta

SEQ ID NO: 304 - DNA, 1574 bp, Panicum virgatum
gcaattggacacgaaatgttgatatactactttaatgatgctgcatggaaggaggctctagctaacattagggaatgcaaataaagaacgggtctttttgttgactcggtgcacaaacacaatgcttccatgtacacgccatctccaactgccacaacatgcgtgctctgtataaatagaggcccagctgcagctccattcttcatctcctcatcagcttccaagtctctcgagcacaattctcctcatctttcattaaaaaaaaacaattctcctcatctcctgggcagcaaacttgattcccggagagttaagagcaagactgtgggttgacggcaatccattgcagatcatgatgaggtcgacgtggttggcgtttgccgtggcggcgctcctcgtcgcctcggtggcacacgcctcgccgtggccgccggggaaactgaaggtcgggttctacaaggactcgtgcccgcaggccgaggacatcgtgcggaacgccgtccgccgcgccctcgagagtgaacctggcgtcggcgccggcatcatcaggatgcacttccacgactgcttcgtccgcggctgcgacgcctccatcctcatcaactccacgccgggcaacaaggccgagaaggactccgtggccaacaaccccagcatgcgcggcttcgaggtcatcgacgacgccaaggccgtcctcgaggcgcactgcccgcgcaccgtctcctgcgccgacatcatcgcgttcgcggcgcgcgacggtgccgacctcgccggcggcatcaagtaccaggtcccctcggggcgccgcgacggccgcgtctccattgaggccgaggtgctcaacaacaacgtccccggacccaccgaccacgtcggcgagctcgtcgagagcttcaggcgcaagggcctctccgccgacgacatggtcacgctctccggcgcgcacaccatcggccgctcccactgctcctccttcacgcagcgcctctacaacttcagcggccagctgggccggaccgacccgtccatcgaccccgcctacgccgagcacctcaagcagcggtgcccatggccgtccagcgacgcccagatggaccccacggtggtgcctctcgaccccgtcacgccggcgaagttcgaaaaccagtacttcaagaacgtgctcgcgcacaaggtcgtgctcacctccgaccagacgctgctcgacagcccgcggacggccgggatcgtcaggttccacgccgctgtcgacaaggcgtggcaggtcaagttcgccgcgtccatgatcaagatgggcaacatcgaggtcctcaccggcgaccagggggagatcagggagaaatgcttcgtcgtcaaccactactagtcacttcaacgaattagctatagtataaagattgctgtttccacgttatagtcgtcgaggttttttctccttttttcaatgtgtgtaattgaacacgtttgtaaagtgaaatgatatcaatgttagtagcaggcatcattactacgcagatttggagtgacttgtccatcgccacacataatcaatttactacgtctttgtgaaataa

SEQ ID NO: 305 - DNA, 1761 bp, Zea mays
cgtctactctctcttgcttttgagaattcgatgcgtgtggcaattaattcagaacaagacaaggtgcatgcatgttttgcagatgttgttaggactttgggagtacgtagttttaatttcaacgatacgacggtgcatggaaggagggtctactgcctagcacacattataggggaaatgccatgatatgattgggactcacttgttgaccgggtgcatatatatgacatgcacacgccaccgccatcttctactccatccaaccgcgacatcatgcagctacttccactttataaatagatcagtgccatattcttcctcatcagcttcaattctcagacacacagcaaaagcaaagcagcttccatcgtccacctccaccatggggtcggcggcttggctggcaacgacagtcgtcttggcggcgctcgcggccgccgcctcctcggtggcggtggcgcacgcctggccaccaccggcggaactggaggtcggcttctacaagcactcgtgcccgcaggccgaggagatcgtgcgcaacgccgtccagcgcggcctggcccgggattcgggcgtcggcgcggggctcgtccgcatgcacttccacgactgcttcgtgcgcggctgcgacggctccatcctcctggactccatgccgggcaacgtggccgagaaggactccgtggcgaacaaccccagcatgcgcggcttcgacgtggtggacgacgccaaggccgtcctcgaggcgcactgcccgcgcaccgtctcctgcgccgacgtcgtggcgttcgcggcccacgacggcgcccacctcgccggcggcatcgactacgccgtcccctcgggccgccgcgacggccgcgtgtcccgagccgacgaggtgctcgtcgacaacgtcccggccccgaccgacgacgtcgccgagctcgtcgagagcttccggcgcaaggggctctccgccgacgacatggtcacgctctccggcgcgcacaccatcggccgctcccactgctcctccttcacgtagcgcctctacaacttcagcggccagctggggcggaccgacccgtccctcgacccggcctacgccgagcaccttaggcaccgctgcccgtggccgtccagcgacggccagatggaccccaccgtggtgcccctcgacccggtcacgccggcgaccttcgacacccagtacttcgagaacgtcctggcgcacagggtcctcttcgtctccgacagtacgctgctccacaacccctggacggccgggatcgtccacttcaacgccgcggtcgacaaggcgtggcaggtcaagttcgcccaggccatggtcaagatgggcaaggtccaggtgctcaccggcgacgagggagagatcagagagaagtgcttcgtcgtcaacccacactactagctaaccaactttctagcagttgcggctccattatttgtaaagggtaatcctagtagccaaaatttcatatataatgcggtaaagtttaatagaaatttgacatatataactatatgttaattaaattgtaataaaacgttttcctcatatttctaaaaaatgaaataccaaagctaaaatagtaccaaattaccgcgtcaattttgtgaagataaaactaccgcatcaacacaacagaacacagaagaatgggatttctattgctttcctcctcattttttttgataaatccagacgattcaaacatatattgtcaaagtcacatattccaaagatttgcatcttca

SEQ ID NO: 306 - DNA, 3993 bp, Sorghum bicolor
ggggaaagcaaagcagcctcctttggtccttgcttctccgtctcctctccatccctccctccaaactttcctcctcttgtccggctcggatcctagcaaaccaccgcgcaccttcccttcctcccacccccggccagcccagcgtgcgcgacgcaacttccggcaatgtgcttgcccacgccacaagtcgccgtcacgtccttacgcgtcaacggcgcggccccacgcccacgcggttgagctgagagagagagagagagagagagagagaggagagcgagagccccctccccaccccccacgcgccctcgtgagtatattacgcacgcggccgcggcagggttgggttggtgggagagggaattcgaatccggcagccggagccgagagagatggagagctacctcaaggagaacttcggggccgtgcaggccaagcactcgtcggaagaggcgctgggacgatggcgcaagctcgtcggcgtcgtcaagaaccccaagcgccgcttccgcttcacggccaacctcgacaagcgcagcgaggccaccgccatgaagaaaaacaaccatgagaagctgcgtgttgccgtgcttgtttcaaaggctgcacttcagttcatcaacagcattgctccatcgagtgagtacaaggtccccgccgatgtcaaggcagctggtttcggcatctgcgctgaggagctgagctcgattgttgagggccatgatgtgaagaagctgaaatctcatggtggtgtccagggcctcgcatccaagctatccacttcggagtctgacggcctcgccacgtctgcagacaagctatcgacccggcggggtgtttttggtgtcaacaagttcgcggaggcggagtcacgtggcttcttggtctttgtctgggaggcgctgcaggacatgacgctcatgatccttgctgtgtgcgcgttcgtctcgctcatggttggcatcgctacggagggatggcccaagggcgcgcatgacgggctcggcattgtggccagtatcctgctggtcgtgtttgtcacagcctcaagcgactaccgccagtccctgcagttcaaggacctcgacaaggagaagaagaagatcacggtgcaggtcacccggagtgggtacaggcagaagctctcaatatatgaacttctcgccggcgacatcgttcacctctccattggtgatcaggtgccagctgacgggctgttcatgtcaggcttctcgcttctgatcaacgagtcgagcttgactggagagagcgagccagttgccgtcaacgctgagaacccattccttctgtcagggacaaaggtgcaagacggttcttgcaagatgctcgtcaccactgtcggcatgaggactcagtgggggaagctgatggccactctcagcgaaggtggtgatgatgagacgccattgcaggtcaagctgaatggtgtggccaccatcattggtaagataggacttatctttgctgtcgtcacattcgcggtgctcaccgaaagcctgttccggcgcaagatcatggatggcacgtacttgagctggactggagatgatgcattggagctgctggagttcttcgccattgctgtcaccattgtcgttgtggcagtacctgaagggctaccgctggctgtgacactgagtcttgcatttgcaatgaagaagatgatgaatgacaaggcacttgtccggcaccttgcagcttgtgagaccatgggctcagcgacctccatttgcagtgacaagactggcactcttacgacaaaccacatgaccgttgtcaaagcctgcatctgtggtaagatcaaagaagtggatggtgattcggataccaagagcctgttctccgaactcccagactctgtcatgacgattctctcccagtccatattcaacaacactgggggagacgttgtcttgaaccaggatggcaaacgtgaaatactggggacaccaactgagacagctattctggagttcgggctgtcactcggtggagacttttcggcagtgcgcaaagcaagcacccttgtaaaggtggagccattcaattctgccaagaagagaatgggagtggtaatccagctcccagagggtgcactgcgagcacactgcaaaggtgcatcagagatcatactggcatcttgtagcaagtacctgaatgaggaaggcaatgtcgtccccctggatgaaggaaccattgatcacttgaaggccacaatcgatagcttcgcaaacgaggcacttcgcactctctgtcttgcctacatggaagttgaggatgggttctcagccaatgatcagatcccgacagatgggtacacctgcattggaattgtggggatcaaagacccagtccggcctggagtgaaggaatctgttgccatctgcaggtcggcaggtattactgtcaggatggtcacaggtgacaatatcaacacggcaaaggcaattgcccgggaatgcggcattttaactgaaggtggcattgccatagaaggcccagatttcagaaccaagagtgaagaagagcttactcaactgataccaaagatacaggtgatggcaagatcttcaccactggataagcatacccttgtcaagcatcttcgaactaaactcgacgaagttgtggcagtgactggtgatgggacaaatgacgcgcctgcgcttcatgaggctgatattgggcttgcaatgggcattgccggaactgaggtggccaaagaaagtgctgatgtcatcattcttgatgacaacttctccactattgttaccgttgcaaaatggggtcgatcagtgtacatcaacattcagaagtttgtgcagtttcagctcactgtcaatgtggttgctctggtggtaaacttctcctcagcttgcctgacagggagtgcccctcttactgccgtgcaattgctctgggtcaacatgatcatggatacactgggtgcactggcattggctacagaacccccaaacaatgaactgatgaagagaacacctgttggaaggaaagggaacttcatcagtaacattatgtggagaaacatcctgggacaggccttctaccagttccttgtaatttggtacctacagacagaggggaagtggttgtttggtatcaagggcgataactccgatctagtcttgaacacacttatcttcaattgcttcgtattctgccaggtgttcaatgagatgagctcgagagagatggagaggataaatgtgtttgaaggcattctaaacaacaatgtgttcattgctgtcctcggcagtactgtcatcttccagttcatcataatacagttccttggcgatttcgcaaacactactcctcttacgctcaaccagtggatagcatgtatttgtatcggtttcataggcatgcctatcgccgctattgtgaagatgataccggttggatcttcgtaggaaactagagctaatttcagccgaaaaccgaagttgggcatagctacagtctgatcatggcaatgaagttttgtgtgttgccatttgtgtacaagatagatctctgctgcctgataatgcttctgtctgtgaatctttcccctttttatcctgtagtgtttgatcttagagcatcatccgagtgtcagccaaggttgtgggcttgatccttagaaaaggcctcggactgctgtagctgttctttgctttattttttttcccctggtgcttttccttggaacattggaggctggatctgtatatggcaaccttgttgttcacccgaatgtgcttgttttgacacctacgtatcattttcatcatctgctaagttatgtttcagtcagaagttccagaaatgagtggggtttaaatgtttctgatttgccaagaaaacgtccccccactagcttccaagatctgataaggccatcattatgcaggagtcttgtgaatcttctgcttctttatgctcgtataaaatccagcaggattcctg

SEQ ID NO: 307 - DNA, 3875 bp, Setaria italica
ctcggatccccagaaaaccaccgcgcacttctttacaccgcgccccccgccttccatccctgcgcgcgcgcgcgcacgacgcagcttcccggcaatgtgctcgcccacgccaccaggcgtcgtcgtcacgtccttgcgcgtcaacgccccggccccacgcagctgaacgcgtcccctccgggctccggcccgcgtgaatatatacgcggccctttcccccggcaggggttggtggaacaaaggggaggaactccgagctggtcgaatcccgcggcggagatggagagctacctcaaggagaacttcgggggcgtgcaggccaagcactcgtcggaggaggcgctggggagatggcgcaaggtcgtcggcgtcgtcaagaaccccaagcgccgcttccgcttcacggccaacctcgacaagcgcagcgaggtcaccgccatgaagcgcaagaaccatgagaagctgcgtgttgccgtgcttgtttcaaaggctgcacttcagttcgttcacagcattactccatcgggtgagtacaaggtccctgccgatgtcaaggaggcgggtttcggcatctgtgccgaggagctgagctcgatagtcgagggtcatgacctcaagaagctgaaatcacatggtggcgtcgagagcctcgcgtccaagctgtccacctcagagtccgatggcctcgccacgtctgcggacaagctggcaaaacgtcaggacctgttcggcgtcaacaagtttgccgaggcagagtcccgcggcttctgggttttcgtctgggaggcactccaggacatgacgctcatgatcctcgccgcgtgcgcattcttctcgctcatcgtcggcatcgccacagagggatggcccaagggcgcccacgacggtctcggcattgtggccagtatcctgcttgtcgtcttcgtcacagcttcaagtgactaccgccagtccctgcagttcaaggacctcgacaaggagaagaagaagatcacggtgcaagtcacccggagtgggtacaggcagaagctctcaatatatgatcttctcgctggtgacatcgtccacctctccattggtgatcaggtgccggctgacgggctgttcttgtcaggcttctcgcttctgatcaacgagtcaagcttgactggagagagcgagccggttgctgtcaatgctgagaaccctttccttctgtcggggacgaaggtgcaggacggttcttgcaagatgctcgtcacgacagttggcatgaggacacagtgggggaagctgatggcaactctcagcgaaggtggtgatgatgagacgccattgcaagtcaagctgaacggtgtggctaccatcatcggtaaaatcggccttatctttgcagtcgtcacatttgcggtgctcaccgaaagcttgttccggcgcaagataaatgatggcacgtacttgagctggactggagatgacgcattggagctgctcgagttctttgccattgctgtcaccatagtcgttgttgcagtacctgaagggctaccactcgccgtgacactgagccttgcatttgcaatgaagaagatgatgaacgacaaggcactcgtccggcaccttgcagcctgtgagaccatgggctcggcgacttccatctgcagtgacaagaccggcacgctcacgacaaaccacatgactgtcgtcaaggcctgcatctgcggcaagattaaagaagtggatggtgcctcggataccaagagcctgttctccgaactgccggactctgtcatgacgatgctctcgcagtccatattcaacaacactggcggtgatgttgtcttcaaccaggatggcaaacgtgaaatactgggcacaccaactgagacagcgattctggagttcggcctgtcgcttggtggagacttttcggcagtacgcaaggctagtacccttgtcaaggtggagccgttcaactctgcaaagaagagaatgggtgtggtcatccagctcccagagggtgcactgcgggcgcactgtaaaggcgcatcagagatcatactggcatcgtgcaacaagtacctgaatgaggaaggcaatgttgtccccctggataaagctaccatagatcacttgaatgcaacaattgacagcttcgcaaatgaggcacttcgcaccctgtgccttgcatacatagaagttcaggaggggttctcagccaatgatcagattccggccgatgggtacacctgcattggcattgtggggatcaaagaccctgtccgccctggagtgaaggaatcagttgccatctgcaggtcggctggtattaccgtcaggatggtcacaggtgacaacatcaacacggcgaaggcaattgcccgggaatgcggtattttaactgaaggtggcattgccatagagggcccagatttcagaaccaagagtgaagaagagctcactcaattgataccaaagatacaggtgatggcaaggtcttcgccattggataagcacacccttgtcaagcatcttcgaactaagcttgaagaagttgttgcggtgactggcgatgggacaaatgatgcacctgcactacatgaggctgatattgggcttgcaatgggtattgctggaactgaggtggccaaagagagtgctgatgtcattattcttgatgacaacttctccactattgtcactgttgcgaaatgggggcggtcagtgtacatcaacattcagaagtttgtgcagtttcagctgacagtaaacgtggttgctcttgttgtaaacttctcttcagcttgcctgacagggagtgctcctcttactgctgtccaattgctctgggtcaacatgatcatggatacacttggtgcactggcattggctacagaacccccaaacaatgaactgatgaagagaacacctgttggaaggaaaggaaacttcatcagtaacattatgtggaggaacatcttgggacagtccttgtaccagttccttgtaatttggtacctacagacagaggggaagtggctgtttggcatcaatggtgataactccgatctagtcttgaacacacttatcttcaattgcttcgtgttctgccaggtattcaatgaggtgagctccagagagatggaaaagataaacgtgtttgaaggcattctaaacaacaacgtgttcgtcgcggtcctcagcagcactgtcatcttccagttcatcataatacagttccttggcgatttcgcaaacactacccctctcacattcaaccagtggatcgcatgcattttcatcggtttcataggcatgcctatcgctgctattgtcaagatgatcccagttggttcttcgtaggaagctagaagctaacttctgccagaaactgaacttgggtaggacttcattctgatcatggcaatggagttttgtacatcttcattggcgtataagatggatgtttctgccataatgcttctatttaggtgaatctttgcccttgttatcctgtatttgatcttagagcatgggccaaggttgtgggcttgattcttagaaaatgcctcggactcgtagctgttctttgctttgttttttttccctggtgtttttcccctggaacagaggctggaactgtatattattgctcaccgcaatgtgcttatttgacacctaccattttgcttaacctggtatccagtcaggaagttccagaaatgggtggggttttaatgtttctgatttgccaagaaaaggccccccactaggttccaagatctgataagaaagatcacgaatcatgcaggatccctgtaaatcttctgctccttgatactcctataaaatccagcaggcctcctgcttttgatatattacaaaaagaaatacag

SEQ ID NO: 308 - DNA, 3683 bp, Panicum virgatum
gcgggcagcaggggttggcggaagagagaagggggggaattagggagctggtccaatccgggagcggagatggagagctacctcaaggagaacttcgggggcgtgcaggccaagcactcgtcggaggaggcgctggggagatggcgcaaggtcgtcggcgtcgtcaagaaccccaagcgacgattccgcttcacggccaacctcgacaagcgcagcgaggtcaccgccatgaagcggaaaaaccatgagaagctgcgtgttgccgtgcttgtttcaaaggctgcacttcagttcatccacggccttgctccatcgagtgagtacaaggtccctgccgatgtcaaggcggcgggtttcggcatatgcgccgaggagctgagctcgatagtcgagggccatgacctcaagaagctgaaatcacacggtggcgtcgagagcctcacgtccaagctatccacctcggagtcggatggcctcaccacgtcggccgacaagttggcgacacggcagcaactgtttggcgtcaacaagttcgccgaggcagagtctcgtggcttctgggtcttcgtctgggaggcgctccaggacatgacactcatgatccttgcagcgtgcgcgttcgtctcgctcatcgttggcatcgccactgaggggtggcccaagggcgcgcacgatgggctcggcattgtggccagcatcctgcttgtcgtgttcgtcacagcttcaagcgactaccgccagtccctgcagttcaaggacctcgacaaggagaagaagaagatcactgtgcaggtcacccggagcgggtacaggcaaaaactctcgatatatgatcttctggccggcgacattgtccacctctccattggtgatcaggtgccggctgacggtctgttcctgtcaggcttctcgcttctgatcaacgagtcaagcttgactggagagagcgagccggttgctgttaatgctgagaacccgttccttctgtctggaaccaaagtgcaggacggttcttgcaaaatgcttgtcacgacagtcggcatgaggactcagtgggggaagctgatggccactctcagcgaaggtggtgatgacgagacaccattgcaggtcaagctgaatggcgtagccaccatcattggtaagataggtctcatctttgcagtcatcacgttcgcagtgctcaccgaaagcctgttccggcgcaagattagcgatggcacatacttgagctggactggagatgatgcattggagctgcttgagttctttgccattgctgtaacaattgtggtcgtggcagtccctgaagggttgccgcttgccgtgacactgagccttgcatttgcaatgaagaagatgatgaatgacaaggcactcgtccggcaccttgcagcctgtgagaccatgggctcggcaacctccatctgcagcgacaagaccggcacactcacgacaaaccacatgactgtcgtcaaggcctgcatctgcggcaagatcaaggaagtggatggtgcctcggataccaagagcctattctccgaactgccggactctgtcatgatgatgctcgcgcagtccatattcaacaacactggcggtgatgttgtcatcaaccaggatggaaaacgtgaaatactgggcacaccgactgagacagcgattctagagttcggcctgtcgcttggtggagacttttctccagtacggcaagcgagcacccttgtcaaggtggaaccgttcaactctgctaagaagagaatgggtgtggtcatccagctcccagggggtgcacttcgagcacactgcaaaggagcttcagagatcatactggcatcatgcaacaagtacctcaatgaggaaggcaatgttgtccccctggataaagcaaccattgatcacttgaatgcaacgattgatagcttcgcaaacgaggcacttcgcaccctgtgtctcgcctacatggaagttcaggatgggttctcagccaatgatcagattccagcagatgggtacacctgcattggcattgtggggatcaaagaccctgtccggcccggagtgaaggaatcagttgccatctgcaggtcggcaggtattactgttaggatggttactggtgacaacatcaacacggcaaaggcaattgcccgggaatgcggcattttaactgaaggtggcattgccatagagggcccagatttcagaaccaaaagtgaagaagagatgactcaattgataccaaagattcaggtgatggcaaggtcttcgccactggataagcacaaccttgtcaagcatcttcgaaataatttggatgaagtagttgcggtgactggtgatgggacaaacgatgcacctgcgctacatgaggctgatattggccttgcaatgggcatcgccggaactgaggtggcaaaagagagtgctgatgtcattattcttgatgacaacttctccactattgtcactgttgcgaaatggggacgatctgtgtacatcaacattcagaagttcgtgcagtttcagcttacagtaaatgtcgttgctctcgttgtaaacttctcctcagcttgcttgacagggagtgctcctcttactgctgtacaattgctttgggtcaacatgatcatggatacactgggtgcactggcattggccaccgaacccccaaacaatgatctgatgaagaggacacctgttggaaggaaaggaaacttcatcagtaacattatgtggaggaacattctgggacaggccttctaccagttccttgtgatttggtacctgcagacagaggggaagtggctgtttggaattaagggtgataactccgatctagtcttgaacacacttatcttcaattgctttgtattctgccaggtattcaatgaggtgagctcgagagagatggagaagataaacgtatttgaaggcattttaaacaacaacgtgttcatcgcggtccttggcagcactgtcatcttccagttcatcataatacagttccttggcgatttcgcaaacaccgcacctctcacattgaaccagtggatcgcatgcatcttcatcggttttataggcatgcctattgctgctattgtcaagatgatcccagttggttcgtcataggaaacttagagctaattcgagccggaaactgaagttgggcaggactggtctgatcatggcaatggagttttgtgcatcgccattaacgtacaagacaaatctttctgccatcatgtttctctttaggtgaatcttagagcatgagctgaggttgtgtgggcttgattcttagaaaatacctcggactctggtagctgttctttgatttctctctttttttttccctggtgctttttcctttgaaagttggagactgtaacagtatatgtcaaatctattgctcactagaattgtcgtggggtttctaggggacccactgccgggtgcgcggagcgcacccgactattcccagagagggagtactcgggaaggtactaggcgattaggttgatctagctttgagacaagcacacaagaacacacgatctagagtggttcgggccgccggagcgtaataccctacatccactgggagaggtattgatcttggctgtgtatgaatctatcctctgccgggccttggctttttcccggcctgagttttccttcta

SEQ ID NO: 309 - DNA, 5982 bp, Panicum virgatum
ccgtgcgggtgaggagtcgcggtcgccgcggtggaccggtgggcgcgcacgcgctcccaccatttttcccggccgcggagaagacgcggcgttgtgttgcagcatgttcctcgcccgtcctcggatctttacggtgaagtgaaacgacacggcgagacgcgctcgcgtcactgtctttgactggacttgaatctccttgcattggccccgacggcccgaccggataaaaaaatcttatgatttagaagtattaaataaattttgtttataattttttttgatagatgagtgttaatttacgagataaatctaatgaacctaattaattcatgatttgctatagtgatactacagtaaccatccttaattacgaattaatatatctcattagattcgtttcgcaatttagtcccagaattatatagttagttttataatcagacttcatttaatactaataaatattaagattctctttgatgtgatatagtgtaaagtttagtctctagaacccaacaaccgacacgcacgctccctcccgctgccgaacttgcacggcaaactgcgtacggggtcgcgagcacgtcgttttcgaccgcaccgggtggctgactctgtgtctagtcttctttctctctaatgagcagcggctctggcgcaagttgagccccactccagcggagatcgtgccgtcgtggagccatgttctgtgtgatactttgtaaccctgggaccatgttgttcgccctgttaagttatgctgcgtgcctccgcctcgagtcgtcgccatcttaatccttctgcgctaaacacacgataatactattgacctcgctcgtcgtggtttacttaaaaattggaccgggggtactctcttcttccttttttttaagaacaaaattgagctggacttattttgccaggatgcgtacgaatctggcctgagcatcggcccaagcccagcccgatccaagcatgcgcgaactttttttaaaataaaaaaaagacgcatgcgcgaaaatttagcaggcgcagcgatgacggcgtgtgtgcagtgcagcgcaacgttcacggagggcgatcggggatcgctgccttcctttcctttccgtccttccttcccatcactttcctcttcctcccgctggtccggccccttcctccctcggatcccaggaaaagcaccgcgcactttcttactccgcccctccccgcgcgggcgcgcacgacgcaacttcccggcaatgtgcagtgtgcttgcccacgccaggcgtcgtcgtcacgtccccgcgcgtcaacggccgggccccacgcagctgaacgcgtccggtccgcgtgaatatatactgcctgcgcgaccctttctcccccggcagaaggggttggcggaagaaggggggaatcagggagcggatgatggagagctacctcaaggagaacttcgggggcgtgcaggccaagcactcgtcggacgaggcgctggggagatggcgcaaggtcgtcggggtcgtcaagaaccccaagcgacgattccgcttcacggccaacctcgacaagcgcagcgaggtcaccgccatgaagcggaaaaaccatgagaagctgcgtgttgtcgtgcttgtttcaaaggctgcacttcagttcattcacggccttgctccatcgagtgagtacaaggtacctgatgatgtcaaggcggcgggtttcggcatctgcgctgaggagctgagttcgatagtcgagggccatgacctcaagaagctgaaatcacacggtggcatcgagagccttgcgtccaagctatccacctcggagtccgatggcctcaccacgtcggccgacaagttggagacacgtcggcaactgtttggcgtcaacaagttcgccgaggcagagtcccgcggcttctgggtcttcgtctgggaggcgctccaggacatgacactcatgatccttgcagcgtgcgcattcgtctcgctcattgttggcatcgccactgaggggtggcctaagggcgcgcacgatgggctcggcattgtggccagcatcctgcttgtcgtgttcgtcacagcttcaagcgactaccgccagtccctgcagttcaaggacctcgacaaggagaagaagaagatcactgtgcaggtcacccggagcgggtacaggcagaaactctcaatatatgatcttctggccggcgacattgtccacctctccattggtgatcaggtgccggctgacggtctgttcttgtcaggcttctcacttctgatcaacgagtcaagcttgactggagagagcgagccagttgctgttaatgctgagaacccgttccttctgtctggaaccaaggtgcaggacggttcttgcaagatgcttgtcacgacagtcggcatgaggactcagtgggggaagctgatggccactctcagcgaaggtggtgatgacgagacgccattgcaggtcaagctgaatggcgtagccaccatcattggtaagataggcctcatctttgcagtcatcacatttgcagtgctgaccgaaagcctgttccggcgcaagatcagcgatggcacatacttgagctggactggagatgatgcattggagctgcttgagttctttgccattgctgtaacaattgtggtcgtggcagtccctgaagggttgccgcttgccgtgacactgagccttgcatttgcaatgaagaagatgatgaacgacaaggcactcgttcggcaccttgcagcctgtgagaccatgggctcggcgacctccatctgcagcgacaagaccggcacactcacgacaaaccacatgactgtcgtcaaggcctgcatctgcagcaagattaaagatgtggatggtgcctcggataccaagagcctattctccgaactgccggactctgtgatgatgatgctctcgcagtccatattcaacaacactggcggtgatgttgtcatcaaccaggatggaaaacgtgaaatactgggcacaccgactgagacagctattctagagttcggcctgtcgcttggtggagacttttctgcagtacggcaagcgagcacccttgtcaaggtggaaccgttcaactctgctaagaagagaatgggtgtggtcatccagctcccagggggtgcacttcgagcacactgcaaaggagcttcagagatcatactggcatcatgcaacaagtacctcaatgaggaaggcaatgttgtccccctggataaagcaaccattgatcacttgaatgcaacgattgatagcttcgcaaacgaggcacttcgcaccctgtgtcttgcctacatggaagttcaggatgggttctcagccaatgatcagattccagcggatgggtacacctgcattggcattgtgggaatcaaagaccctgtccggcccggagtgaaggaatcagttgccatctgcaggtcagcgggtattaccgttaggatggttactggtgataacatcaacacggcaaaggcaattgcccgcgaatgcggcattttgactgaaggtggcattgccatagagggcccagatttcagaaccaagagtgaagaagagatgactcaattgataccaaagatacaggtgatggcaaggtcttcgccactggataagcacacccttgtcaagcatcttcgaaataatctggatgaagttgttgcggtgactggcgatgggacaaacgatgcacctgcgctacatgaggctgatattgggcttgcaatgggcattgccggaactgaggtggctaaagagagtgctgatgtcattattcttgatgacaacttctccactattgtcactgttgcgaaatggggacgatctgtgtacatcaacattcagaaattcgtgcagtttcagcttacagtaaatgtggttgctctcgttgtaaacttctcctcagcttgcttgacagggagtgctcctcttactgctgtacaattgctttgggtcaacatgatcatggatacactgggtgcactggcattggccaccgaacccccaaacaatgatctgatgaagaggacacctgttggaaggaaaggaaacttcatcagtaacattatgtggaggaacattctgggacaggccttctaccagttccttgtgatttggtacctgcagacagaggggaagtggctgtttggaattaagggcgataactccgatttagtcttgaacacacttatcttcaattgctttgtattctgccaggtattcaatgaggtgagctcgagagagatggagaagataaacgtatttgaaggcattctaaacaataacgtgttcattgtggtcctcagcagcaccatcatcttccagttcatcataatacagttccttggcgatttcgcaaacaccacacccctcacattcaaccagtggatcacatgcatcttcattggttttataggcatgcctattgctgctattgtcaagatgatcccagttggttcgtcgtaggaaactagagctaatttgagcgagaaactgaagttgggcgggattatggtctgatcatggcaatggagttttgtgcatcgccattaacgtacaagatagatctttctgccatcatgtttctctttaggtgaatctttgccctttttgtcatgtatttaatcttagagcatgagccaaggttgtgttgtgtgggcttgattcttagaaaatacctcgaactcctgtagctgttctttgatttctcttttttctttttccctggtgcttttccttggaacgttggaggctggagctgtatatggcaaatctattgctcaccagaatgtgattgtttagacacctaccattttgcttcacctgctaatatatgtttcagtcagaagttccagaaatgggtgggtttttaatgtttccgatttgccaagaaaatgccgccccgtagcttccatgatctgatcagatcatgatcgtgcagaagcaggagccttgtaaatcttctgcttcttgatactccaataaaatctagcaggcctcctgcttttggcatatatcaggaagaaaatatatcacaagtttgaccagaagcctgttttttcgttccaaatgccagcgtcagaagatacaccgaagactaaccaggcactgcctgcatcagcctgccaaccgcccagccggttaccttgtttcggcatcccaggcttatcatgacatcacaaattgacctaagcagctcgctcccatgactagcgtcaccactctcatcgatgccaaggcgtttttgaccagtcaaggcactggcctgagctatgttactcctacgagacaaggctctgtttagttccattcttagatttcctagaacggatattctagcctccatatgaaggaccacatgaaatctatttgcaaaacttcttcagagacgggtataaattttcgcgacgaatctaatgacggtaattaattgatgattatctacagtgatactacagtaaccatcctcaaatcacgcgcccagaggtctcattaaaatcttcagagttcctagcgcagagttctgaaattagttttgtaaactagttttgtttgacaccgtaattaccggtcaaagtattactattcccttgaaagaactaaaccaaacaagacagctcctggcttagcacttgcaggaagcaaccactgggaatataattccaacagtaccagccagcagccctgccatgttggttgagttgagcaaacgctaattttttttaccggctgccaggtgcacgacagctcaacatcgcaggacacccaattttttaccaggccatgtccctctcacctcgtgcctagccctcgctcgcttttgaccgcatggtccatccggcctaaagaaacgcggtgcagagattgcaaattgcaacggccctcgggcgaaggcaccttgcatataggggtgcacatgcaccaataaaaagttcaaaattagtaatttagattaatttttcatcatat

SEQ ID NO: 310 - DNA, 3440 bp, Echinochloa colona
tggcagcggagatggagagctacctcaaggagaacttcgggggcgtccaggccaagcactcgtcggaggaggcgctggggagatggcgcaaggtcgtcggcgtcgtcaagaaccccaagcgccgcttccgcttcacggccaacctcgacaagcgcagcgaggtcaacgccatgaagaaaaagaacaacgagaagcttcgtgttgccgtccttgtttcaaaggctgcacttcagttcatccacgcccttcctccaccaagtgagtacaaggtccctgctgatgtcaaggcagcgggttacggcatctgtgccgaggagctgagctctattgttgagggtcatgacctcaagaagctgaaatcacatggtggcgtggagagcctcgcgtccaagctgtccacctcggagtcagatggcctcgccacgtccgaggacaagctggcgacacggcggaaactgtttggcgtcaataagttcgcggaggcagcgtcccgcggcttctgggtcttcgtctgggaggcgctccaggacatgacactcatgatcctcgccgtgtgtgcgttcgtctcgctcattgtgggcgtcgccaccgaggggtggcccaagggcgcgcacgacgggctcggcattgtggccagcatcctgctggttgtgttcgtgacagcatctagtgactaccgccagtccctgcagttcaaggacctcgacaaggagaagaagaagatcacggtgcaggtcactcggagcgggtacaggcagaagctctcaatatatgaccttctcgccggcgacattgtccacctgtccattggtgatcaggtgccggccgacgggctcttcttgtctggattctcactgctgatcaatgagtcgagcttgaccggagagagcgagccagttgctgtcaacgccgagaacccgttccttctgtcggggacaaaagtgcaggacggttcttgcaagatgcttgtcacgacggttggcatgaggactcagtggggcaagctaatggccactctcagtgaaggtggtgacgacgagacaccattgcaggtcaagctgaacggcgtggccaccatcattggtaagataggcctcatctttgcagtcgtcacatttgcagtcctcaccgaaagcctcttccggcgcaagatcaacgacggcacatacttgagctggactggagatgatgcattggagctgctcgagttctttgccattgctgtgacaattgtggtcgtggcagttcctgaaggattgccgcttgccgtgacactgagccttgcatttgcaatgaaaaagatgatgaacgacaaggcacttgtcaggcaccttgcagcctgtgagaccatgggctcggcgacctccatctgcagcgacaagaccggcacactcacgacaaaccacatgaccgtcgttaaggcctgcatctgtggcaagatcaaagaagtggatggtgccacggataccaagagcctgttctctgaactgccagactctgtcatgatgatgctctcgcagtccatattcaacaacactggcggtgacgttgtcttcaatcaggatggcaaacgtgaaatactgggcacaccaactgagacagcgattctagagtttggcctgtcgcttggcggagacttttcggcagtacgcaaagcgagcacccttgtcaaggtggagccattcaactctgccaagaagagaatgggagtagtcatccagctcccagggggtgcactgcgagcacactgcaaaggcgcatcagagatcatactggcatcatgcgacaagtatttgaatgaggaaggcaatgttgtccccctggataaagcaaccattgatcacttgaatgcaacaattgatagcttcgcaaatgaggcacttcgcaccctgtgtcttgcctacatggaagttcaggacgggttctcagccaatgatcagattccagcggatgggtacacctgcattggcattgtgggtatcaaagatcccgtccggcctggagtgaaggaatcagttgccatctgcaggtcggcaggtattactgtcaggatggtcactggtgacaacatcaacacggcaaaggcaatcgcccgggaatgcggcattttaactgaaggtggcattgccatagaaggccctgatttcagaaccaagagtgaagaagagctgacccagttgataccaaagatacaggtgatggcaaggtcttcgccactggataagcacacccttgtcaagcaccttcgaactaaactcgatgaagttgtcgcagtgactggcgatgggacaaacgacgcacctgcgttacatgaggctgatattgggcttgcaatgggcattgctggaactgaggtggctaaagagagtgctgatgtcattattcttgatgacaacttctcaaccattgtcactgttgcaaaatggggacggtcagtatacatcaacattcagaaatttgtgcagtttcagctgactgtcaatgtggttgctctcgttgtaaacttctcctcagcttgcctgacagggagtgctcctcttactgctgtccaattgctctgggtcaacatgatcatggataccctgggtgcattggcactggctacagaacccccaaacaatgagctgatgaagagaacacctgttggaaggaaaggaaacttcatcagtaacattatgtggaggaacatcctgggacaggccttctaccagtttcttgtaatttggtacctacagacagaggggaagtggctctttggaatcaagggcgataatgccgacctagtcttgaacacacttatcttcaattgcttcgtgttctgccaggtcttcaatgaggtgagctcgagagagatggaaaagataaacgtatttgaaggcattctaaacaacaacgtgttcattgccgtcctcagcagcaccgttgtcttccagttcatcataatacagttccttggcgatttcgcaaacactacccctctcacagtcaaccagtggatcgcatgcatttgcatcggtttcattggcatgcctattgctgctatcgtcaagatgatcccggttggttcttcgtagggaactagagctaatttcagccagaaactgaagctgggcaggagtagtctgatcatggcaatggagtatttgtgcatccccattcacgtataagacagatctttctgccataatgcttctattcagatgaatctttgcccttgctatcctgtatttaattttagagcttgagccaaggttgagggcttgattattagaaaacacctcggactcttctagttattattttgtttgtttattaaccttgtgccttttccttgtaacattggaggttggaactgtatatggcaccatgtgcttgactagttgactgctcgttttggcacctgccattttgcttcatctatcaatttacatttcagtaac

SEQ ID NO: 311 - DNA, 3582 bp, Pennisetum glaucum
cgcagctgagagcgcgttcgggcgtgaatatatacgcggacgcgaccctttccccccggcagggcaggggtggtgggttcgtgcttggtgtagtgtaaacaaagaggttggggggaggaggaggaggagctcgagctggtagtcgaatcccgcggcggagatggagagctacctcaaggagaacttcgggggcgtgcagcccaagcactcgtcggaggaggcgctggggagatggcgcaaggtcgtcggcgtcgtcaagaaccccaagcgccgcttccgcttcacggccaacctcgacaagcgcagcgaggtcaccgctatgaagcggaagaaccatgagaagctgcgtgttgctgtgcttgtttcaaaggctgcacttcaatttgttagcagccttgctccatcgggtgagtacaaggtccctgccgacgtcaaggcggctggttttggcatctgcgctgaggagctgagctcgatagtcgagggtcatgacctcaagaagctgaaatcacatggcggcatcgagagcctcgcgtccaagctatccacctcagagtccgatggcctcgacacgtcctcagacaagctggcaaaacggcaggaactgttcggtgtcaacaagttcgccgaggcagagtcccgcggtttctgggtcttcgtctgggaagcgcttcaggacatgacgctcatgatccttgccgcgtgtgcgttcttctcgctcattgttggcatcgccactgaggggtggcccaagggtgcacacgacgggcttggtattgttgccagcatcctgcttgtcgtgttcgtcacagcttcaagcgactaccgacagtcgctgcagttcaaggacctcgataaggagaagaagaagatcacggtgcaagtaacccggagtgggtacaggcagaagctctcaatatatgaacttcttgctggtgacatcgtccacctctccatcggtgatcaggtgccagctgatgggctgttcttgtcaggcttctcgcttctgatcaacgagtcaagcttgactggagagagtgagccggttgctgtcaatgctgagaaccctttccttctgtcggggacaaaggtgcaggatggttcttgcaagatgctcatcacgacagttggcatgaggacccagtgggggaagctgatggcaactctcagcgaagggggtgatgacgagacgccattgcaagtcaagctgaacggtgtggctaccatcattggtaaaataggccttatctttgcagtcgtcacatttgcagtgctcaccgaaagcttgttccggcgcaagataaatgatggcacatacttgagctggactggagatgatgcattggagctgctcgagttctttgccattgctgtcaccatagtcgttgttgcagtacctgaagggctaccacttgccgtgaccctgagccttgcatttgcaatgaagaagatgatgaacgacaaggcacttgtccggcaccttgctgcctgtgagaccatgggttctgcgacctccatctgcagtgacaagaccggcacgctcacgacaaaccacatgactgtcgtcaaggcctgcatctgtggcaagattaaagaagtggatggtgcctcggacgccaagagcctgttctccgaactgccggactctgtcatgacgatgctctcgcagtctatattcaacaacactggtggtgatgttgtcgtcaaccaggatggcaaacgtgaaataatgggtacaccaactgagacagcaattctggagtttggcctgtcgcttggtggagacttttcggcagttcgcaaagctagtacccttgtcaaggtggagccgttcaactcggcaaagaagagaatgggtgtggtcatccagctcccagggggtgcactgcgagcacactgcaaaggagcatcagagatcatactggcctcgtgtgacaaatacctgaatgaggaaggcaatgttgtccccctggataaagcaaccatcgatcacttgaatgcaacgatcgacagctttgcaaatgaggcacttcgcaccctttgccttgcctacatggaagttcaggacgggttctcagccaacgatcagattccagctgatggttacacctgcattggcattgtggggatcaaagaccctgtccgccctggagtgaaggaatcagttgccatctgcaggtcagctggtattaccgtcaggatggttacaggtgacaacatcaacacggcgaaggcaattgcccgggaatgtggcattctaactgaaggtggcattgccatagagggcccagatttcagaaccaagagtgaagaagagctcactcaactgataccaaagatacaggtgatggcaaggtcttcgccattggataagcacacccttgtcaagcatcttcgaactaagctcgatgaagttgttgcggtgactggtgacgggacaaatgatgcacctgcactacatgaggctgatatagggcttgcaatgggcattgctggaaccgaggtggccaaagagagtgctgatgtcattattcttgatgacaacttctccactattgtcactgttgctaaatggggacggtcagtgtacatcaacattcagaagttcgttcagtttcagctgacagtaaacgtggttgctctcgttgtgaacttctcttcagcttgcctgacagggagtgctcctcttactgctgtccaattgctctgggtcaacatgatcatggatacacttggtgcactggcattggctacagaacccccaaacgatgaactgatgaagagaacacctgttggaaggaaaggaaacttcatcagtaacattatgtggaggaacatcctgggacagtccttctaccagttccttgtaatttggtacctacagacagaggggaagtggctgtttggcatcaatggcgctaactccgatctagtcttgaacacacttatcttcaattgctttgtgttctgccaggtgttcaatgaggtgagctccagagagatggaaaagataaacgtgtttcaaggcattctaaacaacaatgtgttcgtcgcggtcctcagcagcaccgtcatcttccagttcatcattatacagttccttggtgattttgcaaacactatccctctcacattcaagcagtggatcgcatgcatttccatcggtttcataggcatgccgatcgccgctattgtcaagatgatcccagttggttcttcgtaggaagctagaagctaacttctaccagaaaccgaagttgggcaggactacggtctgatcatggcaatggagttttgtgcatcgccattggcgtacataagatagatctttctgccataatgattctatttaggtgaatctttgcccttgttatcatgtatttgatcttagagcatgacccaaggttgtgggcttgattcttagcgaaggccttggcccttggactcttgtagctgttctttgcgttgtttttgtttcttttcctggtactttttccttgtagccgaggctggaacagtggaagtttggaactgtatattactccgatattattgctcactacaacgtgcttgttttcacaa

SEQ ID NO: 312 - DNA, 3958 bp, Brachypodium distachyon
cggtcccgtttgacccctctattcccggtcgtttccccagcccagagccccagagcaaaggaaggaggaggtcagggagctctcatgccatgccaccacccgcttaattcccttccctttgccttcctcctcccagtccggatccccatcctaaaaggctcgccaccttccatgaaattcggtccaatacttcttccatgaaagtatcgccggtcgaggtgaggtagtagcgccggagtcggccccacgtacccacgacgacgcgtcaacggcggtcccgcccgtcctcgcttcctcctccccacgcggttgttccaggaaaatgccgctgtgagtctgaggaggcgcgtgctatttaggcgggcagacaagggttggtggggggaaagtggagagggtttcctcgcttgtttgacaggaggagaggagaagggaggggaagggcgccagcagcgatggagagctacctgaacgagaacttcgggggcgtcaaggccaagcactcgtcggacgaggcgctgggccgatggcgcaaggtcgtaggcgtcgtgaagaaccccaagcgccggttccgcttcacggccaacctcggcaagcgctccgaggccgccgccatgaagcgaaccaaccaggagaagcttcgtgttgctgtgcttgtttcaaaggccgcacttcagttcatccacggtcttgctccccagagcgagtacacagtccctgccgatgtgaaggcagcaggctacggcatctgtgccgaggaactgagctcagtcgttgaaagccatgacctcaagaagctgaaagcacatggtggcaccgaggccctcatttctaagatatccacctcagagtcggatgggctcagcacggccaagggcaagcttgcttcccggcaggagatcttcggcatcaacaagtttgccgagacagaggcccgcagcttctgggtcttcgtctgggaagcgctacaggacatgacgctcatgatccttgctgcatgtgcgttcttctctcttgttgtcggcattgccactgaggggtggcccaagggcgcacacgacggcctcggcattgtggccagtattcttctggtcgtgtttgtcactgcgacaagcgactaccggcaatccctgcagtttaaggaccttgacaaggagaagaagaagatcacagtgcaggtcacccggagtgggtaccggcagaagctctcgatatatgatcttcttgtcggtgacattgtgcacctttccattggtgatcaagtgccagctgacggtttgttcgtatctgggttctcgttgctgataaatgaatcaagcctgactggggagagtgaaccggttgctgtcaatgccgagaacccatttcttctgtctggtactaaagttcaagacggttcttgcaagatgctcgtcacaacagtcggcatgaggactcaatggggtaaactgatggccaccctaagtgaaggtggggatgatgagacgccattgcaggtcaagctgaacggcgttgccactatcattggcaaaataggccttgtctttgctgttgtcacatttgcagtgctaactgaaagtctgttccgccgcaagatcatggatggttcgtacttgagttggactggagatgatgcattggaactgcttgagttctttgctattgctgttactattgttgtcgtagcagttcccgaaggcttgccgctcgctgtgaccttgagccttgcatttgccatgaagaagatgatgaatgacaaggcacttgtccgacaccttgcagcttgtgagaccatgggctcagcaacctctatttgcagcgacaagactggcacactcacgacaaaccacatgactgttgtcaaggcctgcatctgtggcaagattaaagaagtggataattcttcggagaccaagagcttattctctgagttgccagattctgccatgacaatgctgtcgcagtccatatttaacaacaccggtggggatgttgtcatcaaccaggatggcaaacgagaaatactgggcacaccaactgagacagcaattctagagcttggcctgtcactcggtggagacttccaggcggtgagaaaagcgagcaccctcgtcaaagttgagccatttaactccgcaaagaagagaatgggagtggtcatccagctgccagggggtgcattccgtgctcactgcaaaggcgcatcagagatcatattggcatcttgcagcaagtacataaatgatcaaggaaatgttgtcccccttgatagtgcaaccgttgctcatttgaatgccactattgatagctttgcaaatgaggcacttcgtactctgtgccttgcctacatcgaagtcgagggtgacttctcagctaatgatccgattcctgaagatgggtacacctgcattggtattgtggggattaaagatccagtgcgtccgggtgtaaaggaatccgttgccatctgcaggtcggcgggtattactgttaggatggtcacaggtgacaatatcaatacagcaaaggcaattgcccgggaatgtggcattttgaccgagggtggtcttgcaattgaaggccctgattttagaattaagagtgcagaagaactgaatgacattgtaccaaagatacaggtgatggcgagatcttcaccccttgacaagcacaccttggtgaagcatcttcggactaagttaggtgaagttgttgcggtgactggcgacgggacaaatgatgcaccagcacttcatgaggctgatattggacttgcgatgggcattgctggaactgaggttgccaaagagagtgccgatgtcattattcttgatgacaacttctccactatagtcactgttgctaaatggggtcgatcagtgtacatcaacattcagaagtttgtgcagtttcaactgacagtcaacgtggttgctctcgttgtgaacttctcatcagcttgcttgacagggagtgctccccttactgctgtccagctgctctgggtcaacatgatcatggacacactaggagcactagcattggctacagaacctccaaacaatgaactgatgaagaggactcctgttggaaggaaagggaacttcatcagcaacattatgtggaggaacatcatgggacaggcattctaccagttccttgtaatttggtatctgcagaccgaaggaaagtggttgtttggaatcaagggcgacaattccgatctagtgttgaacacactcatcttcaattgctttgtgttctgccaggtgttcaatgaggtgagctcaagagagatggaaaggataaatgtattcaaaggcatcctaaacaacaacgtgttcgtcgccgtgctaggtagcactgtcatattccagatcataatagtacagttcctgggtgattttgcgaacactacccctctctcatttaagcaatggttcacctgcatcgtcatcggcttcataggcatgccaatcgctgcgatagtcaagcttatcccggttggttcaagttagtaaaccagaactaatttcagtcaggaactgaagtcaggtagtaggactacgtgctgatgataccggtgcagctttgggcatcgccatgagcataagaaactactctttccgctataatgcattttatctaggtgaatctctgcccttttctttcgcatttgatctagaggatgagccaagattgtgggcttaattcttaaaaatgtgtttagtagacccctgtagcttttgtttatttttgttggtttcctctcgttctttccttggaatggtggaacttggaactgtatatgactcgcctgataaatttgcaccaacctaatgtactgggggcatccgtttgatgtacacctttgacaacgctgtttggattgacttatgtgtcgccatccttgtgcttttaacgggcgaatttttttctatgaactcacgttacacgc

SEQ ID NO: 313 - DNA, 3493 bp, Secale cereale
agagctacctcaacgagaacttcgggggcgtcaagcccaagcactcgtccgacgaggcgctgggccgatggcgcaaggtcgtcggcgtcgtcaagaaccccaagcgccgcttccgcttcaccgccaacctcggcaagcgatccgaggcagccgccatgaagcggaccaaccaggagaagctgcgtgttgctgtgcttgtttcaaaggctgcacttcagttcattcatggtcttgctccccagagtgagtacacagtccctgcagccgtcaaggcagcaggctacggcatctgtgctgaggaactgagctctgttgtcgagagccacgacatcaagaagctgaaagcacatggcggcaccgagggcctcctatcaaaggtgtctacctcagagtcggatggcctcagcacatcacaggacaagcttgcatcccggcaggagatctttggcatcaacaaattcgccgagacagaggcccgcagcttctgggtctttgtctgggaggcgctccaggacatgacactcatgatccttgctgcatgtgccttcttctcactcgtcgtcggcattgccaccgaggggtggcccaagggcgcgcatgatggcctcggcatcgtggctagtattcttctggtagtgtttgtcactgcgacaagcgactaccggcaatccctgcagttcaaggaccttgacaaggagaagaagaagatcacggtgcaggtcacccggagtgggtaccggcagaagctctcgatatacgagcttctcgttggtgacattgtgcacctttccattggtgatcaagtaccagctgacggtttgttcgtatcaggattctcgttgctgattaatgaatcaagcctgactggggagagtgaaccagttgctgtcaatgccgagaacccattccttttgtcaggaactaaagtgcaggatggttcttgcaagatgcttgtgacgacagtcggcatgaggactcaatggggtaaactcatggccaccctcagtgaaggtggggatgatgagacgccattgcaggtcaagctgaacggcgttgcaaccatcattggcaaaataggcctcgtctttgctgtcgtcacatttgcagtgctcactgaaagcctgttccgccgcaagatcatggatggttcgtacttgagttggagtggagatgatgcactggagctgcttgagttctttgctattgctgttactattgttgtcgtagcagttcctgaaggcttaccgctcgccgtgaccttgagccttgcatttgccatgaagaagatgatgaatgacaaggcacttgtccggcaccttgcagcttgtgagaccatgggctcagcaacctccatttgtagtgacaagactggcacactcacaacaaatcacatgactgtcgtcaaggcttgcatctgtggcaaaattaaagaagtggataaatcttcagacaccaagagcttattctctgagctaccggattctgtcatgacaatgctctcgcagtccatatttaacaacactggtggcgatgttgtcatcaaccaggatggcaaacgcgaaatactgggcacaccaaccgagacagcaattctagagcttggcctgtcactcggtggagatttccaggcagtccgaaaagcaaccaccctcctcaaagtcgagccatttaactcagcgaagaagagaatgggagtggtcatccagctgccagggggcgcattccgtgctcactgcaaaggtgcatcagagatcatattggcatcttgcaacaagtacctgaatgatcaaggcaatgccgtcccccttgacagtgcaactattgctcacttgaataacacgattgagagctttgcaaatgaggcacttcgcactctgtgccttgcttacattgaagttgcagatgggttctcagttaatgatgcgattcctgaagaggggtacacatgcattggcattgttgggattaaagacccagtgcgcccgggtgtgaaggaatctgtggccatctgcaggtcagccggtattactgtcaggatggtcacaggcgacaacattaacacagcaaaggcaattgcccgggaatgtggcattttgactgaaggtggtcttgccattgaaggcccagattttagaactaagagtgcagaagaaatgttcaaattgataccaaagatacaggtaatggctaggtcttcaccacttgacaagcacaccttagtgaagaatctccggactacacatgaagaagttgttgccgtgactggtgacgggacaaatgatgccccgcacttcatgaggctgatattggacttgcgatgggcattgctggaactgaggttgcaaaagagagtgccgatgtcattattcttgatgacaacttctccactatagtcacggttgccaaatggggtcgatctgtgtacatcaacattcagaagtttgtgcagtttcaactgacagtcaacgtggttgccctcgttgtgaacttctcgtcagcttgcttgacagggagtgctccccttactgctgttcagttgctctgggtcaatatgatcatggacacactaggagcattggcattggccacagaacctccaaacaatgaactgatgaagaggacccctgttggaaggaaagggaacttcattagcaacgttatgtggaggaacatcatgggacaggcaatctaccagttctttgtaatttggtatctgcagaccgaaggaaagacgttgtttgaacttaagggtgataattcggatctagtcttgaacacgctcatcttcaattgctttgtgttctgccaggtgttcaacgaggtgagctccagagagatggagaggagtaaatgtattcaagggcattctagacaacaacgtgttcgtcgcggtgctcggcagcacggtcatattccagatcatcatagtgcagttccttggcgatttcgcgaacaccaccctcctgtcactcaaggagtggttctcctgcattgtcatcggcttcataggcatgcctatcgccgcgatagtgaagcttttcccggtgggttctcagtaggaggtgccagctaatttccagtcaggaactgaagtgaggtggtaggactacaggctgatggcgatgccaacgcagtttgggcgccgtcgtgagcataagaaactcttctttctgctattaattattaatccgttttatctaggtgatgaattgaatctatggcctttttttcttttgcatttgatatctagaggatgagccaagactgtgggctcgattcttcaaaagtgtttaatagacccttgtagttattttttcttcatgttattttccttggaatgtcggaacttgaaattgtatatgcatcatttgatataagcttgcaccaatctaaagtactggagacatctgtttgattttacatagaaaaaaaaaaaaaaaaaaaaaaaagaaaaaacaaaaaacacacacacacacacacacacatatactac

SEQ ID NO: 314 - DNA, 3373 bp, Triticum aestivum
ccgccatggagagctacctcaacgagaacttcgggggcgtcaagcccaagcactcctccgacgaggcgctgggacgatggcgcaaggtcgtcggcgtcgtcaagaaccccaagcgccgcttccgcttcaccgccaacctcggcaagcgctccgaggccgccgccatgaagcggaccaaccaggagaagctgcgtgttgctgtgcttgtttcaaaggctgcacttcagttcatccatggtcttgctccccacagcgagtacacagtccctgccgccgtcaaggcagcaggctatggcatctgtgctgaggaactgagctctgttgtcgagagccacgacatcaagaagctgaaagcacatggcggcaccgagggcctcatatcaaaggtgtctacctcagagtcggatggcgtcagcacatccaaggacaagcttgcatcccggcaggagatctttggcatcaacaaattcgccgagacggaggcccgcagcttctgggtctttgtctgggaggcgctccacgacatgacactcatgatccttgctgcatgtgccttcttctcgctcgtcgtcggcattgccaccgaggggtggcccaagggcgcgcatgatggccttggcatcgtcgctagtattcttctggttgtgtttgtcactgcgacaagcgactaccggcaatccctgcagttcaaggaccttgacaaggagaagaagaagatcacggtgcaggtcactcggagtgggtaccggcagaagctctcgatatacgagcttctcgttggtgacattgtgcacctttccattggtgatcaagtaccagctgacggtttgttcgtatcaggattctcattgctgattaatgaatcaagcctgactggggagagtgaaccagttgctgtcaatgccgagaacccattccttttgtcaggaactaaagtgcaggatggttcttgcaagatgcttgtgacgacagtcggcatgaggactcaatggggtaaactcatggccaccctcagtgaaggcggggatgatgagacgccattgcaggtcaagctgaacggcgttgcaaccatcattggcaaaataggcctcgtctttgctgttgtcacatttgcagtgctcactgaaagcctgttccgccgcaagatcatggatggttcgtacttgagttggagtggagatgatgcactggagctgcttgagttctttgctattgctgttactattgttgttgtagcagttcctgaaggcttaccgctcgccgtgaccttgagccttgcatttgccatgaagaagatgatgaatgacaaggcacttgtccgacaccttgcagcttgtgagaccatgggctcagcaacctccatttgcagtgacaagactggcacactcacaacgaatcacatgactgtcgtcaaggcttgcatctgtggcaaaattaaagaagtggaaaaatcttcagacaccaagagcttattctctgagctaccggcttctgtcatgacaatgctctcgcagtccatatttaacaacaccggtggcgatgttgtcatcaaccaggatggcaaacgcgaaatactgggcacaccaactgaggcagcaattctagagcttgggctgtcactcggtggagatttccaggcagtgcgaaaagcaaccaccctcatcaaagttgagccatttaactccgcgaagaagagaatgggagtggtcatccagctgccagggggtgcattccgtgctcactgcaaaggtgcatcagagatcatattggcatcttgcagcaagtacctgaatgaccaaggcaatgccgtcccccttgacactgcaactattgctcacttgaatgccacgattgagagctttgcaaatgaggcacttcgcactctgtgccttgcttacattgaagttgcagatgggttctcagctaatgatgcaattcctgaagaggggtacacatgcattggcattgttgggattaaagacccagtgcgcccgggtgtgaaggaatctgtcgccatctgcaggtcagccggtattactgtcaggatggtcacaggcgacaacattaacacagcaaaggcaattgcccgggaatgtggcattttgactgaaggcggtcttgccattgaaggcccagattttagaactaagagtgcagaagaaatgtataaattgataccaaagatacaggtaatggctaggtcttcaccacttgacaagcacaccttagtgaagaatctccggactacacatgaagaagttgttgccgtgactggtgacggaacaaatgatgcacccgcacttcatgaggctgatattggacttgcgatgggcattgctggaactgaggttgcaaaagagagtgccgatgtcattattcttgatgacaacttctccactatagtcacggttgccaaatggggtcgatctgtgtacatcaacattcagaagtttgtgcagtttcaactgacagtcaacgtggttgccctcgttgtgaacttctcgtcagcttgcatgacagggagtgctccccttactgctgttcagttgctctgggtcaatatgatcatggacacactaggagcattggcattggccacagaacctccaaacgatgaactgatgaagaggactcctgttggaaggaaaggaaacttcattagcaacattatgtggaggaacatcatgggacaggcaatctaccagttctttgtaatttggtatctgcagacggaaggaaagacgttgtttgaacttaagggtgataattccgatctagtcttgaacacgctcatcttcaattgctttgtgttctgccaggtgttcaacgaggtgagctccagagagatggagaggataaatgtattcaaaggcattctaaacaacaacgtgttcgtcgcggtgctcggcagcacggtcttattccagatcatcatagtacagttccttggcgatttcgcgaacaccacccctctgtcactcagggagtggttctcctgcatcgtcatcggcttcataggcatgcctatcgccgcgatagtcaagctcttcccagtgggttctcagtaggagacgacaactaatttgcagtcaggaactgaagtgaggtagtaggactacaggctgatggtgatgccaacgcagtttgggcgctgtcgtgagcataagaaactcttctttctgctgttaatccgttttatttatctaggtgaattgaatctatggccttttgtcttttgcatttgatctttagaggatgagccaagactgtgggcttgattcttcaaaagtgtttaatagaccctttttagttattttttcatgttattttccttggaatgttgaacttgaaattgtatatgcatcaacctaaa

SEQ ID NO: 315 - DNA, 3720 bp, Secale cereale
cgctcccctcttcctcccccgtccccgccccgctcggatccatcaatcatcccctacctaaaaaactcgccaccttccatgaaattaaccacccacaaggacagaaaacttccatgaaagtatcgccgatcgaggtagcaccggagtcggacccacgtacccacgacgcgtcaacgacggtcccccacgcgtttccttccgggaaaatgccggtctgagccgcgtgctgctatatagatacggcggagttggtggggaggggggaagcagagacgaggaggaggggaggtttcctttgacgacagggagagcagagcagggacgccgccatggagagctacctcaacgagaacttcgggggcgtcaagcccaagcactcgtccgacgaggcgctggggcgatggcgcaaggtcgtcggcgtcgtcaagaaccccaagcgccgcttccgcttcaccgctaacctcggcaagcgatccgaggcagccgccatgaagcggaccaaccaggagaagctgcgtgttgctgtgcttgtttcaaaggccgcacttcagttcatccatggtcttgctccccagagtgagtacacagtccctgcagccgtcaaggcagcaggctacggcatctgtgctgaggaactgagctctgttgtcgagagccacgacatcaagaagctgaaagcacatggcggcaccgagggcctcctatcaaaggtgtctacctcagagtcggatggcctcagcacatcacaggacaagcttgcatcccggcaggagatctttggcatcaacaaattcgccgagacagaggcccgcagcttctgggtctttgtctgggaggcgctccaggacatgacactcatgatccttgctgcatgtgccttcttctcactcgtcgtcggcattgccaccgaggggtggcccaagggcgcgcatgatggcctcggcatcgtggctagtattcttctggttgtgtttgtcactgcgacaagcgactaccggcaatccctgcagttcaaggaccttgacaaggagaagaagaagatcacggtgcaggtcacccggagtgggtaccggcagaagctctcgatatacgagcttctcgttggtgacattgtgcacctttccattggtgatcaagtaccagctgacggtttgttcgtatcaggattctcgttgctgattaatgaatcaagcctgactggggagagtgaaccagttgctgtcaatgccgagaacccattccttttgtcaggaactaaagtgcaggatggttcttgcaagatgcttgtgacgacagtcggcatgaggactcaatggggtaaactcatggccaccctcagtgaaggcggggatgatgagacgccattgcaggtcaagctgaacggcgttgcaaccatcattggcaaaataggcctcgtctttgctgtcgtcacatttgcagtgctcactgaaagcctgttccgccgcaagatcatggatggttcgtacttgagttggagtggagatgatgcactggagctgcttgagttctttgctattgctgttactattgttgtcgtagcagttcctgaaggcttaccgctcgccgtgaccttgagccttgcatttgccatgaagaagatgatgaatgacaaggcacttgtccgacaccttgcagcttgtgagaccatgggctcagcaacctccatttgtagtgacaagactggcacactcacaacaaatcacatgactgtcgtcaaggcttgcatctgtggcaaaattaaagaagtggataaatcttcagacaccaagagcttattctctgagctaccggattctgtcatgacaatgctctcacagtccatatttaacaacactggtggcgatgttgtcatcaaccaggatggcaaacgggaaatactgggcacaccaaccgagacagcaattctagagcttggcctgtcactcggtggagatttccaggcagtccgaaaagcaaccaccctcctcaaagtcgagccatttaactcagcgaagaagagaatgggagtggtcatccagctgccagggggcgcattccgtgctcactgcaaaggtgcatcagagatcatattggcatcttgcaacaagtacctgaatgatcaaggcaatgcgtcccccttgacagtgcaactattgctcacttgaataacacgattgagagctttgcaatgaggcatccgtataccctgtgtgccttgcttacattgaagttgcagatgggttctcagttaatgatgcgattcctgaagaggggtacacatgcattggcattgttgggattaaagacccagtgcgcccgggtgtgaaggaatctgtcgccatctgcaggtcagctggtatcactgtcaggatggtcacaggcgacaacattaacacagcaaaggcaattgcccgggaatgtggcattttgactgaaggtggtcttgccattgaaggcccagattttagaactaagagtgcagaagaaatgttcaaattgataccaaagatacaggtaatggctaggtcttcaccacttgacaagcacaccttagtgaagaatctccggactacacatgaagaagttgttgccgtgactggtgacgggacaaatgatgcacccgcacttcatgaggctgatattggacttgcgatgggcattgctggaactgaggttgcaaaagagagtgccgatgtcattattcttgatgacaacttctccactatagtcacggttgccaaatggggtcgatctgtgtacatcaacattcagaagtttgtgcagtttcaactgacagtcaacgtggttgccctcgttgtgaacttctcgtcagcttgcttgacagggagtgctccccttactgctgttcagttgctctgggtcaatatgatcatggacacactaggagcattggcattggccacagaacctccaaacaatgaactgatgaagaggacccctgttggaaggaaaggaaacttcattagcaacgttatgtggaggaacatcatgggacaggcaatctaccagttctttgtaatttggtatctgcagaccgaaggaaagacgttgtttgaacttaagggtgataattcggatctagtcttgaacacgctcatcttcaattgctttgtgttctgccaggtgttcaacgaggtgagctccagagagatggagaggataaatgtattcaagggcattctagacaacaacgtgttcgtcgcggtgctcggcagcacggtcatattccagatcatcatagtgcagttccttggcgacttcgcgaacaccacccctctgtcactcaaggagtggttctcctgcattgtcatcggcttcataggcatgcctatcgccgcgatagtcaagcttttcccggtgggttctcagtaggaggtgccagctaatttccagtcaggaactgaagtgaggtggtaggactacaggctgatggcgatgccaacgcagtttgggcaccgtcgtgagcataagaaactcttctttctgctattaattaatccgttttatctaggtgatgaattgaatctatggcctttttttcttttgcatttgatctctagaggatgagccaagactgtgggcttgattcttcaaaagtgtttaatagacccttgtagttatttttttcatgtttttttcccttggaatgtcggaacttgaaattgtatatgcatcatttgatataagcttgcaatcaac

SEQ ID NO: 316 - DNA, 3251 bp, Avena sativa
cgccatggagagctacctcaacgagaacttcgggggcgtcaagcccaagcactcctccgacgagtcgctgggccgatggcgcaaggtcgtcggcgtcgtcaagaaccccaagcggcgattccgcttcaccgccaacctcgacaagcggtccgaggcggctgccatgaagcggaccaaccaggagaagctgcgtgttgctgtgcttgtttcaaaggctgcacttcagttcatccacggtcttgcgccccagagcgattacacagtccctgcagatgtcaaggcagcaggctatggcatctgtgccgaggaactgagcgctgttgtcgagagccatgacatcaagaagctgaaagcacacggtggcaccgagggcctcttatctaaggtgtctacctcagagtctgatggtatcagcacggcctcccagagcaaacttgcgtctcggcaggagatcttcggcatcaacaagttcgccgagacggagtcccgcagcttctgggtctttgtctgggaggcgctccaggacatgacgcttatgatccttgctgcatgcgccttcttctcgctcgtcgttggcattgccaccgaggggtggcccaagggcgcacatgacggccttggcattgttgccagtattcttctggttgtgtttgtcactgcgacaagcgactaccggcaatccctgcagttcaaggaccttgataaggagaagaagaagatcacggtacaggtcaccaggagtgggtaccggcagaagctctcgatatatgaacttctcgttggtgacattgtgcacctttccattggtgatcaagtaccagctgacggtttgtttgtatctgggttctcgttgctgattaatgaatcaagccttactggggagagtgagccagttgctgtcaatgccgagaacccattccttctgtcaggcactaaagtgcaagatggtgcttgcaagatgcttgtcacgacagtcggcatgaggacccaatggggtaaactcatggccaccctgactgaaggtggtgatgatgagacgccactgcaggtcaagctgaacggtgttgccaccatcattggcaaaataggccttgtctttgcagtcgtcacatttgcagtgctcactgaaagcctgttccggcgcaagatcatggatggctcgtacttgagttggtctggtgatgatgcactggagctccttgagttctttgctattgctgttactattgtcgtcgtagcagttcctgaaggcttaccgctcgctgtgaccttgagccttgcatttgccatgaagaagatgatgaatgacaaggcacttgtcagacaccttgcagcttgtgagaccatgggatcagcaacctccatttgcagcgacaagactggcacactcacgacgaaccacatgactgttgtcaaggcctgcatctgtggcaaagttaaagaagtggataattcatcagacaccaagagcttattctctgagttgccagaatctgtcatgacaatgctcttgcagtcgatatttaacaacaccggtggtgatgttgtcatcaaccaggatggcaaacgcgaaatactgggcacaccaactgagtcagcaattctagagcttggcctgtcactgggtggagatttccaaggggtgcgaaaagcaagcacccttatcaaagtcgagccattcaactcggcgaagaagagaatgggagtggtcatccagctgccagggggtggattacgtgctcactgcaaaggagcatcagagatcatattggcatcttgcagcaagtacctgaatgatcaaggacttgttgttccccttgatactgcaaccgttgctcacttgaatggtacgattgatagctttgcaaatgaggcacttcgtactctgtgccttgcctacatagaagtcggggatgggttctcagctaatgatcagattcctgaagatgggtacacctgcattggcattgtggggattaaagacccagtgcgtccgggtgtgaaggaatctgttgcaatctgcaggtcagccggtattactgttaggatggtcacaggtgacaacatcaacacagcaaaggcaattgcccgggaatgcggcattttgactgaaggtggtcttgccattgaaggcccagattttagaactaggagcgcagaagaactgcataaattgataccaaagatacaggtaatggctagatcttcaccacttgacaagcacaccttggtgaagaatctccgtactacatttgaggaagttgttgcagtgactggtgacgggacaaatgatgcccctgcacttcatgaggctgatattggacttgcgatgggcattgctggaactgaggttgcgaaagagagtgccgatgtcattattcttgacgacaacttctccactatagtcaccgttgctaaatggggccggtcagtgtacatcaatattcagaagtttgtgcagtttcagctgacagtcaatgtggttgctctcgttgtgaacttctcatcagcttgcttgacagggagtgctccccttactgctgtccagttgctctgggtcaacatgatcatggacacactaggagcattggcattggccacagaacctccaaacgatgaactgatgaaaaggactcctgttggaaggaaaggaaacttcatcagcaacattatgtggaggaacatcatgggacaggcactctaccagttcattgtaatttggtatctgcagacagaaggaaagacgttgtttggactcaagggtgataactccgatctagtcttgaacactctcatcttcaattgctttgtgttctgccaggtgttcaacgaagtgagctctagggagatggagaggataaatgtattcaaaggcattctagacaacaatgtattcgttgccgtgcttggcagcacagtcatattccagatcataatagtgcagttccttggtgatttcgcgaacacttcgcctctctcattcaagcagtggttctactgcatcgtcatcggcttcataggcatgcctatcgctgcaatagtcaagctattcccggtcggttctaattaggatgccataactaattccagtcaggtagtaggactacagtccgatgatgccaatgcagctcgggcactgttctttctgtggatctctatgccctttttcttcttcatttgatctagaggatgacctagactcttgtagttactttcttatgttactttcctcctatttgtttgcttggaat

SEQ ID NO: 317 - DNA, 3719 bp, Aegilops tauschii
cgccccgttcggatccatcaatcatccaccgctcccacctaaaaaactcgccaccttccatgaaatcagccacccccaaggacagaatacttccatgaaagtatcgcccatcgaggtagcaccggagtcggacccacgtacgcacgacgcgtcaacgacggtcctgccctcaccttccctaccccacgcccacgcgcttccttccgggaaaatgccggtctgagccgcggcgtgctatatagacacggcggagttggtggggaggagaggagaggagagaagggtttcattggtccgttgaccggacaggagcagagacgccgccgccatggagagctacctcaacgagaacttcgggggcgtcaagcccaagcactcctccgacgaggcgctgggccgatggcgcaaggtcgtcggcgtcgtcaagaaccccaagcgccgcttccgcttcaccgccaacctcggcaagcgatccgaggccgccgccatgaagcggaccaaccaggagaagctgcgtgttgccgtgcttgtttcaaaggctgcacttcagttcatccatggtcttgctccccagagcgagtacacagtccctgccgcagtcaaggcagcaggctacggcatctgtgctgaggaactgagctctgttgtcgagagccacgacatcaagaagctgaaagcacatggcggcaccgagggcctcctatcaaaggtgtctacctcagagtcggatggcgtcagcacatccaaggacaagcttgcatcccggcaggagatctttggcatcaacaaattcgccgagacggaggcccgcagcttctgggtctttgtctgggaggcgctccacgacatgacactcatgatccttgctgcatgtgccttcttctcgctcgtcgtcggcattgccaccgaggggtggcccaagggcgcgcatgatggcctcggcatcgtcgctagtattcttctggttgtgtttgtcactgcgacaagcgactaccggcaatccctgcagttcaaggaccttgacaaggagaagaagaagatcacggtgcaggtcatccggagtgggtaccggcagaagctctcgatatacgagcttctcgttggtgacattgtgcacctttccattggtgatcaagtaccagctgacggtttgttcgtatcaggattctcgttgctgattaatgaatcaagcctgactggggagagtgaaccagttgctgtcaatgccgagaacccattccttttgtcaggaactaaagtgcaggatggttcttgcaagatgcttgtgacgacagtcggcatgaggactcaatggggtaaactcatggccaccctcagtgaaggcggggatgatgagacgccattgcaggtcaagctgaacggcgttgccaccatcattggcaaaataggcctcgtctttgctgttgtcacatttgcagtgctcactgaaagcctgttccgccgcaagatcatggatggttcgtacttgagttggagtggagatgatgcactggagctgcttgagttctttgctattgctgttactattgttgttgtagcagttcctgaaggcttaccgctcgccgtgaccttgagccttgcatttgccatgaagaagatgatgaatgacaaggcgcttgtccgacaccttgcagcttgtgagaccatgggctcagcaacctccatttgcagtgacaagactggcacactcacaacaaatcacatgactgtcgtcaaggcttgcatctgtggcaaaattaaagaagtggaaaaatcttcagacgccaagagcttattctccgagctaccggattctgtcatgacaatgctctcgcagtccatatttaacaacactggtggcgatgttgtcatcaaccaggatggcaaacgcgaaatactgggcacaccaactgaggcagcaattttagagcttggcctgtcactcggtggagatttccaggcagtgcgaaaagcaaccaccctcatcaaagtcgagccatttaactcagcaaagaagagaatgggagtggtcatccagctgccagggggtgcattccgtgctcactgcaaaggtgcatcagagatcatattggcatcttgcagcaagtacctgaatgatcaaggcaatgccgtcccccttgacagtgcaactgttgctcacttgaatgccacgattgagagctttgcaaatgaggcacttcgcactctgtgccttgcttacattgaagttgcagatgggttctcagctaatgatgcgattcctgaagaggggtacacatgcattggcattgttgggattaaagatccagtgcgcccgggtgtgaaggaatctgttgccatctgcaggtcagccggtattactgtcaggatggtcacaggcgacaacattaacacagcaaaggcaattgcccgggaatgtggcattttgactgaaggtggtcttgccattgaaggcccagattttagaactaagagtgcagaagaaatgtacaaattgataccaaagatacaggtgatggctaggtcttcaccacttgacaagcacaccttagtgaagaatctccggactacacatgaagaagttgttgccgtgactggtgacgggacaaatgatgcacccgcacttcatgaggctgatattggacttgcgatgggcattgctggaactgaggttgcaaaagagagtgccgatgtcattattcttgatgacaacttctccactatagtcacggttgccaaatggggtcgatctgtgtacatcaacattcagaagtttgtgcagtttcaactgacagtcaacgtggttgccctagttgtgaacttctcgtcagcttgcatgacagggagtgctccccttactgctgttcagttgctctgggtcaatatgatcatggacacactaggagcattggcattggccacagaacctccaaacgatgaactgatgaagaggacccctgttggaaggaaaggaaacttcattagcaacattatgtggaggaacatcatgggacaggcaatctaccagttctttgtaatttggtatctgcagaccgaaggaaagacgttgtttgaacttaagggtgataattccgatctagtcttgaacacgctcatcttcaattgctttgtgttctgccaggtgttcaacgaggtgagctccagagagatggagaggataaatgtattcagaggcattctagacaacaacgtgttcgtcgcggtgctcggcagcacggtcttattccagatcatcatagtacagttccttggcgatttcgccaacaccacccctctgtcactcagggagtggttctcctgcatcgtcatcggcttcataggcatgcctatcgccgcgatagtcaagctcttcccagtgggttctcagtaggagatgccaactaatttgcagtcaggaactgaagtgaggtagtaggactacaggctgatggtgatgccaacgcagtttgggcgctgtcgtgagcataagaaactcttttttctgctgttaatccgttttatttatctaggtgaattgaatctatggccttttttttcttttgcatttgatctttattagaggatggaccaagactgtgggcttgattcttcaaaagtgtttaatagacccttttagttattttttcatgctattttccttggaatgttggaacttgaaattgtatatgcatcaacctaaacctaaagtacttgggaca

SEQ ID NO: 318 - DNA, 3358 bp, Setaria italica
ctagctgcggtagaaaggaagccagtcgagatggagagctacctgaaggagaactttgggggcgtgaaggcgaagcactcgtcggacgaggcgctgggccgatggcgcagcgtcgtcggcgtcgtcaagaaccccacgcggcggttccgcttcaccgccaacctcgacaagcgctccgaggccgccgccatgaagcgctccaaccaggagaagctccgcgtcgccgtcctcgtctccaaggccgcgctccagttcatccacggcctcccgccgcaggccgactacgcggtccccgccgccgtcgcggcggcgggcttcggcgtgtgcgcggaggagctgagctccgtcgtggagagccacgacgtgaagcgcctcaagtcccacggcggggtggagggcgtcgtgtccaagctctccacatcggcgtccgacggcctccctgcgtcggcgcgcaagctggctacgcgccaggagctcttcggcgtcaaccggttcgcggaggccgagccccgcagcttctgggtcttcgtgtgggaggcgctccaggacatgacgctcatgatcctcgccgcctgcgcgctcgtctccctcctcgtcggcgtcgccaccgagggctggccccacggcgcgcacgacgggctcggcatcgtcgccagcatcctcctcgtcgtcttcgtcaccgccaccagcgactaccgccagtcgctgcagttcaaggacctcgacaaggagaagaagaagatcaccgtgcaggtcacccggggcgggtaccggcagaagctctcgatctacgacctcctcgtcggcgacatcgtccacctctccattggagatcaggtgcctgccgacgggctgtttgtgtccgggttctcgctgctcatcaacgagtcgagcctcactggcgagagcgagcccgtcgccgtcaacgccgagaacccgttcctgctgtcggggaccaaggtgcaggacggctcgtgcaagatgctcgtcaccaccgtcggcatgaggacgcagtggggcaagctgatggccaccctcagcgagggcggcgacgacgagacgccgctgcaggtcaagctcaacggcgtcgccaccatcatcggcaagatcggcctcatcttcgccgtcgtcacgttcgccgtgctcacccaggccctattctggcgcaaggtctccgacggctcctacttcagctggaccggggatgacgcgctggagctgctcgagttcttcgccatcgccgtcaccatcgtcgtcgtcgccgtccccgagggcctgccgctcgccgtcacgctcagcctcgcgttcgccatgaagaagatgatgaacgacaaggcgctcgtccgccacctcgccgcctgcgagaccatgggatccgccacctccatctgcagcgacaagaccggcacgctcaccaccaaccacatgaccgtcgtcaaggcctgcatatgcggcaaggtcaaggacgtgggcagctcatcggcggagaccaagaccttgacctccgacctgccgagctccgtcgtggcgatgctcctgcagtccatcttcaacaacaccggcggcgacgtcgtcgtcaaccaggacggcaagcgcgagatactgggcacgcccaccgagaccgccatcctggagttcgggctgtcgctgggcggtgacttctccaccgtccgcaaggcgagcaccctcatcaaggtcgagccgttcaactcggcgaagaagaggatgggggtggtcatccagctccccggcggcgctctgcgagctcactgcaagggcgcgtcagagatcatcctggcatcgtgcaccaagtacatggacgagcacggcaacgtcgtcgagcttgacggcgcaaccgtggatcacctaaaggctaccattgacagcttcgccaacgaggcgcttcgcacgctgtgccttgcctacatcgacgtcgacgaggggttctcggcaaacgatcagattccaatggatgggtacacctgcattggcattgtggggatcaaggaccctgtccgtcctggcgtcaaggaatcggtcgccatctgcaggtcagcaggcatcaccgtcaggatggttacgggtgacaacatcaacacggccaaggcgattgcgcgggaatgcggcattttgactgaaggtggcgttgccattgaaggaccagacttcagagtcaagagtgaagaagaattacaggaactgataccgaaaatacaggtgatggcaaggtcttcgccacttgacaagcacacattggtcaagcatcttcggactacatttgatgaagttgtcgcggtgactggtgatggcacaaatgatgcacctgcacttcatgaagctgatattgggcttgcaatgggcattgctggaactgaggtcgcaaaagagagtgccgatgttatcattcttgatgacaacttctccactatagtcactgttgctaaatggggtcgatcagtgtacatcaatattcagaagtttgtgcagtttcagctgacagtaaatgtggttgctctcgttgtaaacttctcctcggcttgcttgatagggagtgctcctcttactgctgtgcaattgctctgggtcaacatgatcatggacacactaggcgcattagcattggccacagaacctccaaacaatgagctgatgaagagaactccggttgggaggaaaggaaacttcatcagcaacatcatgtggaggaacatcatgggacaggccatctaccagttccttgtgatctggtatctgcaggctgaagggaaatggctcttcggaatcaagggtgacaactccgatctagtcttgaacacaatcatcttcaactgcttcgtattctgccaggttttcaatgaggtgagctcaagggagatggagaggataaacgtcttcgagggcatcctagacaacaacgtgttcgccgccgtcctcggcagcaccgtggtcttccagttcatcatcatccagttcctcggcagcttcgcgaacacgacccctctcacgttcacgcagtggatcgcctccatcttcatcggcttcataggcatgccgatcgccgccgcggtgaagatggtcccggtcgattccgtgtaggaaacacagctagttcctgtcagaattcagaaactgaagcccggcaattttggccgttgccatttgcataacatagcttgctttccctgtgtaatgcatttaggtgagtcactgaaaatttacattgcttttgatatagaggttgagccagggtaacgggcctgattattcaaagtgttgatgttgaataggatcatgtagcttttggtatttcaattttttctccctgtgtttcctgtggaactctggaattgtatatggc

SEQ ID NO: 319 - DNA, 3793 bp, Oryza sativa
ctgcccctgcatgcgcgcgatcatgcatgcacgcatcccctcccgctgctgctccctcctcctcctcctcgcatccgtcaggtcacttcctaaaaaaacacaggaaactacgcaaaaactcccatgattccgaccagccgaacactttccccacaaaaaaaattgcgctgaagttgccgtcagagagtcgccttcacgaacgccattgtgcgagttgacgcgtttcttcgcggaagaaaccaatgcccgcgttggctatatagaaagggtttgggttggcggtggggaggagatcggaggagggggtcgttggattgggacccaattgaaagggaaaggttgaagaggcgcaatggagagctacctgaaggagaatttcggcggggtgaaggcgaagcactcgtcggacgaggcgctggggcgatggcgcaggttggtcggcgtcgtcaagaaccccaagcggcggttccgcttcaccgccaacctcgacaagcgatccgaggccgccgccatgaagcgatccaaccaggagaagctgcgagttgctgtgctagtgtcaaaggctgcacttcagttcatccaaggacttgctccggcgagcgagtacacggtccccgacgacgtcaaggcggcgggctacggcatctgcgccgaggagctgagctccatcgtggagagccacgacatcaagaagctcaagtcccatggcggcgtggaggccatcgcggcgaagctgtgcacctcgccggaggacgggctcccgaagtcgaggcgccggcaagccgtccgggaggagctgttcggcatcaacaggttcgccgagacggagtcgcgcagcttctgggtgttcgtctgggaggcgctccaggacatgacgctgatgatcctcgcggcgtgcgccttcttctccctcgtcgtcggcatcgccaccgaggggtggcccaagggcgcgcacgacgggctcggcatcgtggccagcatccttctcgtcgtcttcgtcacggcgaccagcgactaccggcagtcgctgcagttcaaggacctcgacaaggagaagaagaagatcacggtgcaggtctcccggaacgggtacaggcagaagctgtccatctacgacctcctcgccggcgacatcgtgcacctctccatcggcgaccaggtgcccgccgatggcttgttcctgtccggattctcgctgctcatcaacgagtcgagcctgaccggggagagcgagcccgtcgccgtcaatgccgagaacccgttcctcctgtcggggaccaaggtgcaggatggttcttgcaagatgctcgtcacgacggtcgggatgaggacgcagtggggtaagctgatggccacgctgagcgagggcggcgacgatgagacgccgttgcaggtgaagctcaacggcgtcgccaccatcatcggcaagatcggcctcatcttcgcagtcgtcacgttcgccgtgctcaccgagggcctcttccggcgcaagatcatggacgcctcgtacctgagctggaccggagacgacgcgatggagctgctcgagttcttcgccatcgccgtcaccatcgtcgtcgtggccgtccccgaaggcctcccgctcgccgtgacgctcagcctcgcgttcgccatgaagaagatgatgaacgacaaggcgctcgtccggcacctcgccgcctgcgagaccatgggctcggcgaccaccatctgcagcgacaagaccggcacgctcacgaccaaccacatgaccgtcgtcaaggcctgcatctgcggcaagatcaaagacgtggagagcgcctcggacaccaagagcttgttctccgagctgccggagtccgccatgacgctgctctcgcagtccatcttcaacaacaccggcggcgacgtcgtcttcaacaagagcgggagtcgcgagatacttggcacaccaaccgagacggccatcctcgagttcggcctctcactcggcggcgacttcctggccgtgcgcaaggcgagcaccctcgtcaaggtggagccattcaactcggccaagaagagaatgggagtggtcatccagctccccggaggagcaatgcgtgcacacagcaagggcgcgtcagagatcatcttggcatcttgcagcaagtacctgaatgatcaaggcaacgtcgtgccactcgacgatgcaaccgttgctcacctgaacgccacgatcaacagctttgcaaacgaggcgctccgtaccttgtgccttgcctacgtcgatgtcggtgacgggttctcggcgaatgaccagattcctgaagatggctacacctgcattggcattgtggggatcaaagatccagttcgtcctggtgtgaaggaatcggttgccatctgcaggtcggcagggatcatggtgaggatggtcacaggtgacaacatcaatacagcgaaggcgattgcgcgggaatgcggcattttgactgaaggtggcattgccattgaaggaccggatttcagaaccaagagtgcagaggaactgaatgagttgataccaaaaatacaagtgatggctagatcttcaccacttgacaagcacaccttggtgaagcatctccggaccacttttgatgaagttgttgcggttactggtgatggcacaaatgatgctcctgctcttcatgaagctgatattggacttgcaatgggcattgctggaactgaggtggcaaaagaaagtgctgacgtgattattcttgacgacaacttctccactatagtcactgttgctaaatggggtcggtcagtgtacattaatattcagaagtttgtgcagtttcagctgacagtcaatgtggtcgctctgatagtgaacttctcctcagcttgcttgacagggagtgctcctcttactgctgtccaactgctctgggttaacatgatcatggacacactaggagcactggcattggcaactgaacctccaaacgatgaactgatgaagagaactcctgttggaaggaaagggaacttcatcagcaacattatgtggagaaacatcctgggacaggccttctaccaattcattgtaatatggtatctgcagacagaagggaagtggctatttggactaaagggagaaaattccgatctagtcttgaacacactcatcttcaattgctttgtgttctgccaggtgttcaatgaggtgagctcaagggagatggagaggataaatgtatttgaaggcattctagacaacaacgtgttcgtcgccgtcctcggcagcacagtcatcttccagttcataatagtacagttcctgggtgatttcgccaacacgactcctctcacattgaagcagtggttcaactgcattttcatcggtttcatagggatgccgatcgctgctgcggtcaagctgatcccagttgatttctaagtaggaaagcagaactaattcaagacacgggactgaagtcggtagggattagaggcagtaccatgggcataacaaagttctctttatgcgcttgtttagatgtgaacctctgccccccccccccccccccctttttttcttgcagagtatgatccaagattgtatggtgtttaatggactcgtgtagatctttccttcatgtcattttcctcatgttctttccttggaatgttggaacttgcaattgtatatggatcgcttgataagtttgacatttgtttgattctacacccttgagtccttgacagggtgtatgaattgactcgtgtaagtttcttcccttgttgccatcctactgtttttttgtggccaatctgggac

SEQ ID NO: 320 - DNA, 3753 bp, Sorghum bicolor
gatgggcagccctccatcactcccctgccgtccgtcttgttaggatcctgaacaaaccaccacgcctcgtcctctccgactctccatcggcgtatttgcgcatgtcctgagtagtcctgaccgaccacatcgccatcgccatcgccatagcatcgggatcgagcagcttcccaaggatgctgcagctgggctgaggagagcgagcgatcgagagatcatcatcgagggtcagaggtgcagtgtggtgtgagcgagggaggaagaaaagatggaaagctacctgaacgaaaacttcgggggcgtgaaggcgaagcactcgtcggacgaggcgctggggcgatggcggagcgtcgtcggcgtcgtcaagaaccccacaaggcggttccgcttcaccgccaacctgggcaagcgctccgaggcggccgccatgaagcggtccaaccaggagaagctgcgtgtcgccgtgctcgtctccaaggccgcgctccagttcatccacggcctgcccccgcagggcgactacgccgtccccgccgacgtcaaggcggcgggcttcggcatctgcgccgaggagctcggctccatcgtggagagccacgacgtgaagaagctcaagtcccacggcggcgtcgacggcctcgtgtccaggctgtccacctcggcgtccgacggcctcgctgataacgacaacaagctgatggcggcgcggcaggaggtcttcggcgtcaaccgcttcgccgaggcggagcaacgcagcttctgggtcttcgtgtgggaggcgcttcaggacatgacgctcatgatcctcgccgcctgcgcgctcgtctccctcctcgtcggcatcgccaccgaagggtggccccacggcgcgcacgacgggctcggcatcgtcgccagcatcctgctcgtcgtcttcgtcaccgccaccagcgactaccgccagtcgctgcagttcaaggacctcgacaaggagaagaagaagatcaccgtgcaggtcacgcggagcggctaccgccagaagctctccatctacgacctcctcgccggcgacatcgtccacctctccatcggcgaccaggtgcccgcggacgggctcttcgtgtccgggttctcgctgctcatcaacgagtccagcctcaccggcgagagcgagcccgtcgcggtgagcgccgagaacccgttcctgctgtcggggaccaaggtgcaggacggcgcgtgcaagatgctcgtcaccaccgtcggcatgaggacgcagtggggcaagctgatggccacgctcagcgagggcggcgacgacgagacgccgctgcaggtcaagctcaacggcgtcgccaccatcatcggcaagatcggcctcgccttcgcggtcgtcacgttcgcggtgctcacccagggcctcttctggcgcaagttcgccgacggctcctacttcagctggaccggcgacgacgcgatggagctgctcgagttcttcgccatcgcggtcaccatcgtcgtcgtggcagtccctgagggcctgccgctcgccgtgacgctcagcctcgcgttcgccatgaagaagatgatgaacgacaaggcgctcgtccggcacctcgcggcatgcgagaccatgggctccgccaccaccatctgcagcgacaagaccggcacgctcaccaccaaccacatgaccgtcgtcaaggcctgcatctgcggcaagatcaaggacgtgagcagctccgcggagaccaagacgctgccctccgacctgccggcgtccgtcgtggcgatgctcctgcagtccatcttcaacaacaccggcggcgacgtcgtgctcaaccaggacggcaagcgcgagatcctgggcacgcccaccgaggccgccatcctggagttcggcctctccctcggcggcgacttctcggcggtgcgcaaggcgagcacgctcctcaaggtggagcccttcaactcggccaagaagaggatgggggtggtcatccagctccccggcggcgagctgcgggcgcactgcaagggcgcgtcggagatcatcctggcgtcctgcacaaagtacctggacgagcacgggaacgtcgtctccctcgacggcgccaccacggaccacctcaaagccaccatcgacagcttcgccaacgaggcgctccggacgctgtgcctcgcctacgtcgacgtcggcgatgggttctcggcgaacgatcagattccgatggaagggtacacgtgcatcggcgtcgtggggatcaaggaccccgtccgtcccggcgtgaaggaatcggtggcgatctgcaggtcggcaggcatcaccgttaggatggttactggtgacaacatcaacacggccaaggcgattgcgcgagaatgcggcattctgactgaaggtggcgtcgccattgaaggcccggacttcagagtcaagagtgaagaagaactgcaacaactgattccaaaaatacaggtgatggcaagatcttcgccgcttgacaagcacaacttggtgaagcatctacgaactacatttgatgaagttgtcgcggtgaccggtgatggcacaaatgatgcgcctgcgctacatgaagctgatattgggcttgcaatgggcattgctggcactgaggtggctaaagagagtgctgatgttattattctcgatgacaacttctccaccatagtcactgttgccaaatggggtcgatcggtgtacatcaacattcagaagttcgtgcagtttcaactgacagtcaatgttgttgctctcattgtcaacttctcttcagcttgcttaatagggagtgctcccctgacagctgtgcagttgctctgggtcaacatgatcatggacacactaggagcactggcactggccacagaacctccaaacgatgagctcatgaaaagaactcctgttggaaggaaaggaaacttcatcagcaacatcatgtggaggaacatcatgggacagtccttctaccagttccttgtgatttggtatctgcagtctcaagggaaatggctcttcggaatcgagggcgctaactctgatctgctcctgaacacaatcatcttcaactgctttgtattctgccaggttttcaacgaggtgagctcaagagagatggagaggataaatgtgttccaaggcattctagacaacaacgtgttcgccatggtcctcggcagcaccgtcgtcttccagttcataatcatacagttcctcggcagcttcgccaacacgacccctctcagcttcacgcagtggatgtcctgcatcgccatcggattcataggaatgcctatcgccgtggtggtgaagatggtccctgtggattctgtgtagggaaactactctctcagaattcagaaaactgaagccagcaagcaggcagtttttgccattgcttgcccacgtaacacagctatgtttgtttttcatgcagctaggtgagtcactgatgcccatcttccttgtttatgatctagaattctagaggtcgagcgccaaggcatgcaatgagctcgattctgaaaagtgttgagtagaatcttgtagctcttgatgtttcagtttttttcccagatgttcttcctttggaagtagtaactgttggcttgaaatgtttacagcagcaccgattttttttaagaacagaacaggctttattcatttgtgattctacaaagggttcctgcctcttgagatattatgctgtaattttgtgccacgggtcggagagcataaccatgctgctctttttt

SEQ ID NO: 321 - DNA, 3479 bp, Saccharum officinarum
agcccctcgccggcagcaccggtccagaattcccggctagacacacgcgtccggtgccatgacttgaagaagctgttgtctcatggtggcgtccagggcctcgcgtccaagctatgcacttcggagtctgacggcctcaccacgtccgcggacaagctagcaacccggcgggatgtctttggcgtcaacaagttcgcggaggcggagtcccgtggtttcttggtcttcgtctgggaggcgttgcaggacatgacactcatgatccttgccgcgtgcgcgtttgtctcactcattgttggcatcgccacggagggatggcccaagggcgcgcacgacgggctcggcattgtggccagcatcctgctggtcgtgttcgtcacagcgtcaagcgactaccgccagtccctgcagttcaaggacctcgacaaggagaagaagaagatcacggtgcaggtcacccggagcgggtacaggcagaagctctcaatatatgaacttctcgccggtgacatcgttcacctctccattggtgatcaagtgccggctgatgggctgttcatgtcaggcttctcgcttctgatcaacgagtcgagcttgactggagagatcgagccagttgccgtcaatgctgagaacccattccttctttcagggacgaaggtgcaggacggttcttgcaagatgctcgtcaccactgtcggcatgaggactcagtgggggaagctgatggccactctcagtgaaggtggtgatgacgagacgccattgcaggtcaagctgaatggtgtggccaccatcattggtaagataggacttatctttgctgtcgtcacattcgcggtgctcaccgaaagcctgttccggcgcaagatcactgatggcacatacttgagctggactggagatgacgcattggagttgcttgagttcttcgccattgctgtcaccattgtcgttgtggcagtacctgaagggctaccgcttgccgtgacactgagccttgcattcgcaatgaagaagatgatgaacgacaaggcactcgtccggcaccttgcagcctgtgagaccatgggctcagcgacctccatttgcagtgacaagaccggcactctcacgacaaaccacatgactgtcgtcaaagcctgcatttgtggtaagatcaaagaagtggatggtgcttcagatgccaagagcctgtcctccgaactcccagactctgtcatgacgatcctctcccagtccatattcaacaacactgggggcgacgttgtcttgaaccaggatggcaaacgtgaaatactggggacaccaactgagacagctattctggagttcgggctgtcactcggtggagacttttccgcagtgcgcaaagcaagcacccttgtaaaggtggagccattcaactctgccaagaagagaatgggagtggtaatccagctcccagagggcgcactgcgagcacactgcaaaggtgcatcagagatcatactggcatcttgcagcaagtacctgaatgaggaaggcgatgtcatccccttggatgaaggaaccattgatcacttgaaggccacaatcgatagcttcgcgaacgaggcacttcgcactctctgtcttgcctacatggaagttgaggatgggttctcagtcaatgatcagatcccaacagatgggtacacctgcattggcattgtggggatcaaagacccagtccggcccggagtgaaggaatcagttgccatctgcaggtcagcaggtattaccgtcaggatggtcacaggtgacaacatcaacacggcaaaggcaattgcccgggaatgcggcattttaactgaaggtggcattgccatagaaggcccagatttcagaaccaagagtgaagaagagcttactcaactgataccaaagatacaggtgatggcaagatcttcgccactggataagcatacccttgtcaagcatcttcgaactaaactcgacgaagttgtggctgtgactggtgatgggacaaatgatgcgcctgcgcttcatgaggctgatattgggcttgcaatgggcattgctggaaccgaggtggccaaagagagtgctgatgtcatcattcttgatgacaacttctccactattgttaccgttgcaaaatggggtcgatcagtgtacatcaacattcagaagtttgtgcagtttcagctcactgtcaatgtggttgctctggtggtaaacttctcctcagcttgcctgacagggagtgcccctcttactgctgtgcaattgctctgggtcaacatgatcatggatacactgggtgcactggcattggctacagaacccccaaacaatgaactgatgaagagaacacctgttggaaggaaaggaaacttcatcagtaacattatgtggagaaacatcctgggacaggccttctaccaattccttgtaatttggtacctacagacagaggggaagtggttgtttggaatcaagggcgataactccgatctagtcttgaacacactgatcttcaattgcttcgtattctgccaggtattcaatgaggtgagctcgagagagatggagaggataaatgtgtttgaaggcattctaaacaacaacgtgttcattgctgtcctcggcagcaccgtcatcttccagttcatcataatacagctccttggtgatttcgcaaacaccacccctcttacgctcaaccagtggatagcatgtatttttatcggtttcataggcatgcctatcgcagctattgtgaagatgataccagttgggtcttcgtaggaaactagagctaatttcagccggaaaccgaagttgggcatggctacagtttgatcatggcaatgaagttttctgcattgccatttgtggacaagatagatctctgctgcctggtaacgcttctgttttagtgaatcttcgccctttttatcctgttgccctgttctgcaggtcatgtttcggcttgtttcagcttatttcagcttattctctctcacataatactattgaatcagccgaaatcagccggcttttccaccagccgaaccagccctgtatatgtagtctttgatcttagagcatcatccgagcgtcagccatggttgtgggcttgattcttagaaaatgcctcggactcctgtagctattctttgctttatttatttatttttccatggtgcttttccttggaacatttggaggctggagctgtatatggcaatcttcttgttcacccggatgtgcttgttttgacacttacgtacgtacggagtatcattttgcttcatcacccaccaaaacaacttccttatgcatttatacaacttttctttattggccggtgggggcggggggatataaaggatccgagctttcgtttcggggggttgagaggtataatttctttctataggggccactaattcaatcttcctggcccactttttacaactgtgaaaccggag

SEQ ID NO: 322 - DNA, 4676 bp, Zea mays
aggttgatccatatatacgaacgaacatgtcaccgcagcaaccaagagcaagcgtcttctccaatccggaagagcgtaagaccggtggacaaagagaggaagaagaaaagatgtgctgttactcctgccatctcaaggtgatctgggacaggatggtgccgagctgcctgcacctgcaggaccaaggccagagcggcgagagggtggccctggcggcggcggcggccggagccgacgcgaggcagctcaccctggaggagatgctgtacccgccgccgagctgggagacggcggaggaggctgcgacgccgtcgcggcgcagctccccgaaggtgtgcccggtgaacctggccgacttcttctcggacgaggagggagcggactccgggaccgggagcggcggcggctactccgcgccgggcgtcaacgagagcgcgtccgtgtccgtcgtcagccgggcgtcgctccggggcctgcacagcgtgtcccggagggtgagcttcaggtcccccgacgagtccgacgtgttcatcatcccggcgagaggccactccgacgacgacgatgagtggagcagtgacggtgagccaagcaggacgtgacgtgaacaaaccaagaagagagagagttcatgccagtggcaggttctgcaatatgatgagtggaggaccggacgtgagtacgtgacacgtcctgcaggattgttagctgtttttcttggcaagaaaacatgcacatgttcatgttgcattcttgtttgtgcgtgtgttctttttgccgtgacatgtagagacacccgtagactgcatctgcatcgatctccggcgtttcaggggtttagttttgagtagtggcagcccacaaattccggcagatctccgagagtggaggaggaggtggcggtcgctccgtcgacgggcttccctccatcactctcctgctgcccgtcttgtgcggatcctgaacaagccaccacgcctcgtcttgtgctcttctcctctcgatcgcgcatgtcctgtcctgacctgaccggcccatcgccatcgccatagcatcgggggtcgagcagctcggcgaaatgacgcagctgggctgaggagagcggtcgatcgagagatcatccatcggggtcagggactcagggtgtgagcgagggtgtaggtagggtgggtaaagatggacaagatggagagctacctgaacgagaacttcgggggcgtcaaggcgaagcactcgtcggacgaggcgctggggcgatggcggagcgtcgtcggcgtcgtcaagaaccccaccaggcggttccgcttcaccgccaacctgggcaagcgctccgaggccgccgccatgaagcgatccaaccaggagaagctgcgggtcgccgtgctcgtctccaaggccgcgctccagttcatccacggcctgccgccgcagggcgactacgccgtgcccgccgacgtcaaggcggccggcttcggcatctgcgccgaggagctgagcttcatcgtggagagccacgacgtgaagaagctcaagtcccacggcggcgtggacggcctcctgtccaggctgtccacctcggcgtccgacggcctcgacggtagcaagctgatggcggcccggcaggagctcttcggcgtcaaccgcttcgccgaggcggagccccgcagcttctgggtcttcgtctgggaggcgctccaggacatgacgctcatgatcctggccgcctgcgcgctcgtctccctcgtcgtcggcatcgccaccgaggggtggccccacggcgcgcacgacgggctcggcatcgtcgccagcatcctgctcgtcgtcttcgtcaccgccaccagcgactaccgccagtcgctgcagttcaaggacctcgacaaggagaagaagaagatcacagtgcaggtcacgcggagcgggtaccgccagaagctctccatctacgacctcctcgcgggcgacatcgtgcacctcgccatcggcgaccaggtgcccgccgacgggctcttcgtgtcgggcttctccctgctcatcaacgagtccagcctcaccggagagagcgagcccgtcgcggtgagcgccgagaacccgttcctgctgtcggggaccaaggtgcaggacggcgcgtgcaagatgctggtcaccaccgtcggcatgcggacgcagtggggcaagctcatggccacgctcagcgagggcggcgacgacgagacgccgctgcaggtcaagctcaacggcgtggccaccatcatcggcaagatcggcctcgccttcgccgtggtcacgttcgcggtgctcacgcagggcctgttctggcgcaagctcgccgacggctcctacttcagctggaccggcgacgacgcgctggagctgctggaggtcttcgccatcgccgtcacgatcgtcgtcgtggccgtccccgagggcctgccactggccgtgacgctcagcctggcgttcgcaatgaagaagatgatgaacgacaaggcgctcgtgcggcacctcgcggcctgcgagaccatgggctccgccaccaccatctgcagcgacaagaccggcacgctgaccaccaaccacatgaccgtcgtgaaggcctgcatctgcggcaaggtgaaggacgtgaacagctccgcggagaccaagacgctgccctccgacctgccggcgtccgtcgtggcgatgctcctgcagtccatcttcaacaacaccggcggcgacgtcgtgctgaaccaggacagcaggcgcgagatcctgggcacgccgaccgaggccgccatcctggagttcgggctcgccctcggcggcgacttcgcgacggtgcgcaaggcgagcaccctgctcaaggtggagcccttcaactcggcaaagaagaggatgggggtggtcatccagctccccggcggcgcgctgcgggcgcactgcaagggcgcgtcggagatcgtcctggcgtcctgcgccaggtacctggacgagcacggcaacgtcgccgccctcgacggcgccaccgcggaccacctgagggccaccatcgacagcttcgccaacgaggcgctccggacgctgtgcctcgcctacgtcgacgtcggcgacgggttctccccgagcgaccagatcccgacggacgggtacacgtgcatcggcgtcgtggggatcaaggatcccgtacgtcccggcgtcaaggagtcggtggcgatctgcaggtccgctggcatcaccgtcaggatggtcacgggcgacaacatcaacacggccaaggcgatcgcgcgggagtgcggcatcctgactgaaggcggcgtagccatcgaaggcccggatttcagagtcaagagtgaggaggaactgcaagatctgatacccaaaatacaggtgatggcgagatcttcgccgctcgacaagcacaccttggtgaagcacctacgaacaacatttgatgaagttgttgcggtcaccggcgatggcacaaacgatgctcctgcgctacacgaagccgacattgggcttgcgatgggcattgctggcactgaggtgcaccttatcgtttctagtaatgtttgtttgaaggtggcgaaagagagcgccgacgtgatcattctcgacgacaacttctccaccatagtgactgtcgccaaatggggccggtcggtgtacatcaacatccagaaatttgtgcagttccagctgacagtcaacgtcgttgcgctcatcgtcaacttctcttcagcttgcctgatagggagcgcgcccctgactgcggtgcagctgctctgggtgaacatgatcatggacacgctgggagctctggcgctggccacggagccccccaacgacgagctcatgaagaggactcccgtcggaaggaaagggaacttcatcagcaacaccatgtggaggaacatcatggggcaggccatctaccagttcctcgtcatctggtacctgcagtctagggggaaacggctcttctggatcgacgagggcgccgccgacgccgacctggtcctgaacacggtcatcttcaactgcttcgtgttctgccaggttttcaacgaggtgaactcgagggagatggagagggtgaacgtgttccgaggcatcctggacaacaacgtgttcgtcatggtcctcggcagcaccgtcgtgttccagttcgtgatcgtgcagtgcctcggtagcttcgccaacacgacccctctcagcctcgcgcagtgggtcgcctgcgtcgccatcgggttcgtaggcatgcctatcgccgtggcggtgaagatggtgccggtggagtaggccggccttcagtggaggcagccaggcagttttggccgttgttgcttgccctcgtcatacagacatcttcctcgcttatgatctagacttctctggaggtcgagccgccatggcgatcggctcgattctgaaaagtgttgggtagaatcttgtagctttgaaagtttcagtttcagttttttttttgttcccagacgttcttcatttggaagtagtaactgttggcttgaaatgtttattacagatgtactgatttttttaagaacagaacaggttttattcatttgttattctacaaagggttcctgtgtcttgagatatagtgttgtaatttcttgtaacggatcggtgagcatagtttgtgttagatttataagaggagccacgaataagcc

SEQ ID NO: 323 - DNA, 3998 bp, Zea mays
ctgaaatagctctttaaagagagcagaagccagtttagctcctaaaagccggagcccaaaaaacctgttctcacaccggctcctcgcccatcccagtgcgcaggcaccacgtgcagcctctcccaccacgcgcagcctctcactggcgttcagtaaagagccgttttgtcaaacgatttgtaaaagacatcggctctagcagagaagctgctcctttaaaagagcaacggttggagtcagttttaaaggagccagagccctcccaaacagggccttagagttttgatgactactagtggccagtggtagtggagtggcagcccacaaattccggcagatttccgagcgtggtgggggtctgggggaggtggcagtcgctccgtcgacgggctgccctccatcactctcctgccatccgtcctgttcggatccagaacaaaccactgccacgcgcccacgcctcgacgtctcctctcgatctcgcacgtcctgaccggcccatcgccatcgccacagcatcgggaccgagcagctcgccgaggatgctgcagctgggctgagcctgaggagagcgaccgatcgagagatcatcgatcgaggatcagggacgactcagggtgtgaccgtccgtgtgcgcgaggttgggcgcgcgggcaaagatggagagttacctgaacgagaacttcgggggcgtcaaggcgaagcactcgtcggaggaggccctggggcgatggcggagcgtggtcggcgtcgtcaagaaccccaccaggcggttccgcttcaccgccaacctgggcaagcgctccgaggccgccgccatgaagcggtccaaccaggagaagctgcgggtcgcggtgctcgtctccaaggccgcgctccagttcatccacggcctgccgccgcagggcgactacgccgtccccgccgacgtcaaggcggccggcttcggcgtctgcgccgaggagctgggcgccatcgtggagacccacgacgtgaagaagctcaagtcccacggcggcgtggacggcctcgtatccaggctgtccacctcggcgtccgacggcctcgacgatagtaacgagccgatgacggcggcccggcaggagctcttcggcgtcaaccgcttcgccgaggcggagccccgcagcttctgggtcttcgtgtgggaggcgctgcaggacatgacgctgatgatcctcgccgcctgcgcgctcgtgtctctagtcgtcggcatcgccaccgaggggtggccccacggcgcgcacgacgggctaggcatcgtcgccagcatcctgctcgtcgtcttcgtcaccgccaccagcgactaccgccagtcgctgcagttcaaggacctggacaaggagaagaagaagatcgccgtgcaggtcacgcggcgcgggtaccggcagaggctctccatctacgacctcctcgcaggcgacatcgtgcacctctccatcggcgaccaggtgcccgccgacgggctcttcgtgtcgggcttctcgatgctcatcgacgagtccagcctcaccggggagagcgagcccgtggcggtgagcgccgagaacccgttcctgctgtcggggaccaaggtgcaggacggcgcgtgcaagatgctggtcaccaccgtcggcatgcgcacgcagtggggcaagctgatggccacgctcagcgagggcggcgacgacgagacgccgctgcaggtcaagctgaacggtgtggccaccatcatcggcaagatcggcctcgccttcgccgtcgtcacgttcgcggtgctcacgcagagcctgttctggcgcaagctcgccgacggctcctggctcagctggactggcgacgacgcgctggagctgctcgagttcttcgccatcgccgtcaccatcgtggtcgtggccgtccccgagggcctgccgctggccgtgacgctcagcctcgcgttcgccatgaagaagatgatgaacgacagagcgctcgtgcgccacctggcggcctgcgagaccatgggctccgccaccaccatctgcagcgacaagaccggcacgctgaccaccaaccacatgaccgtcgtcaaggcctgcatctgcggcaaggtgagggacgtgaacagctccgtggagaccaagacgctgccctccgacctgccggcgtccgtcgtggccatgctcctgcagtccgccttcaacaacaccggcggcgacatcgtgctcgaccaggacgggaggcgcgagatcctgggcacgccgaccgaggcagccatcctggagttcgggctgtccctgggcggcgacttcgcggcggtgcgcaaggccagcacgctcctcaaggtggagcccttcaactcggccaggaagaggatgggggtggtcatccagctccccggcggcgcgctgcgggcgcactgcaagggcgcgtcggagatcgtcctggcgtcctgcaccaggtacctggacgagcgcggcagcgccgtcgccctggacggcgcgaccgcggaccgcctcagggccaccatcgacagcttcgccaacgaggcgctccgcacgctgtgcctcgcctacgtggacgtcggcgacgggttctccccgagcgagcagatcccgacggacgggtacacgtgcatctgcgtcgtggggatcaaggaccccgtccgtcccggcgtgaaggagtcggtggcgatctgcaggtccgcaggcatcaccgtcaggatggtcacgggcgacaacatcaacacggccaaggcgatcgcgcgggaatgcggcatcctgactgacggcggcgtcgccattgaaggccccgacttcagagtgaagactgaagaagagctgcaagaactgataccaaagatacaggtgatggcaagatcttcgccgcttgacaagcacaccctggtgaagcatctacgaactacgtttgacgaagttgtcgcggtgaccggcgatggcacgaacgatgcacccgcgctacacgaagccgacattgggcttgcgatgggcattgctggcactgaggtggccaaggagagtgccgacgtcattatcctcgacgacaacttctccaccatagtcactgtcgccaaatggggccgatcggtgtacatcaacatccagaagttcgtgcagtttcagctgacagtcaacgtcgtcgctctcgttgtcaacttctcctcagcttgcttgatagggagcgctcccctgacagccgtgcagctgctgtgggtgaacatgatcatggacacgctgggagcgctggcgctggccacggagcctccgaacgacgagctgatgaagaggacccccgtggggaggaaagggaacttcatcagcaacgtcatgtggaggaacatcatggggcaggccctgtaccagttcctcgtcatctggagcctgcagtctcgagggaaatcgctcttcgggatcgagggccgcgccgactcggacctcgtcctcaacaccatcatcttcaactgcttcgtcttctgccaggttttcaacgaggtgagctcgagggagatggagagggtgaacgtgctccgaggcatcctagacaacaacgtgttcgccatggtgctcggcagcaccgtcgtgttccagttcgtgatcgtccagtgcctgggcagcttcgccaacacgacccctctcagcgtcgcgcagtggggcgcctgcgtcgccatcgggttcgtcggcatgcccgtcgccgtggcggtgaagatggtgccggtggagtaggcgggcctctcgatctctctcggagttgagaaactggaggcaggcaggcgggcagtagttgttggcttgaaatgtctataacagcagtattcttttttttttgtggtaagaacagaacagaacagaacaggctttatccatctgtgattcttgttaagtaaccctagttagggttatgtgggcaaatacctgctttgtccctgaggggtctcacatctctatataaggaacatgtacaccacgtcataatacagagatcagaaagaggccagaggt

SEQ ID NO: 324 - DNA, 3204 bp, Triticum aestivum
gtgcttgtttcaaaggctgcgcttcagttcatccatggcctcgctccccagagcgagtacacagtccctgctgctgtcaaggcagcaggctatggcatctgtgctgaggaactgagctctgttgtcgagagccacgacatcaagaagttgaaagcacatggcggcactgagggcctcttatcaaaggtgtctacctcagagtcggatggcgtcagcacatccaaggacaagcttgcatcccggcaggagatctttggcatcaacaaattcgccgagacggaggcccgcagcttctgggtctttgtctgggaggcgctccaggacatgacactcatgatccttgctgcatgtgccttcttctcgcttgtcgtcggcattgccaccgaggggtggcccaagggcgcgcatgatggcctcggcatcgtggctagtattcttctggttgtgtttgtcactgcgacaagcgactaccggcaatccctgcagttcaaggaccttgacaaggagaagaagaagatcacggtgcaggtcacccggagtgggtaccggcagaagctctcgatatacgagcttctcgttggtgacattgtgcacctttccattggtgatcaagtaccagctgacggtttgttcgtatcaggattctcattgctgattaatgaatcaagcctgactggggagagtgaaccagttgctgtcaatgccgagaacccattccttttgtcaggaactaaagtgcaggatggttcttgcaagatgcttgtgacaacagtcggcatgaggactcaatggggtaaactcatggccaccctcagtgaaggaggggatgatgagacgccattgcaggtcaagctgaacggcgttgcaaccatcattggcaaaataggcctcgtctttgctgttgtcacatttgcagtgctcactgaaagcctgttccgacgcaagatcatggatggctcgtacttgagttggagtggagatgatgcactggagctgcttgagttctttgctattgctgttaccattgttgtcgtagcagttcctgaaggcttaccgctcgccgtgaccttgagccttgcttttgccatgaagaagatgatgaatgacaaggcacttgtccgacacctggcagcctgtgagaccatgggctcagcaacctccatttgcagcgacaagactggcacactcacaacgaatcacatgactgtcgtcaaggcttgcatctgtggcaaaattaaagaagtggataaatcttcaaacaccaagagcttattctctgagctaccggattctgtcatgacaatgctctcgcagtccatatttaacaacactggtggcgatgttgtcatcaaccaggatggcaaacgcgaaatactgggcacaccaacagagacagcaattctagagcttggcctgtcactcggtggagatttccaggcagtgcgaaaagcaaccaccctcctcaaagtcgagccatttaactcagcgaagaagagaatgggagtggtcatccagctgccagggggcgcattccgtgctcactgcaaaggtgcatcagagatcatattggcatcttgcagcaagtacctgaatgatcaaggcaatgccgtcccccttgacagtgcaactattgctcacttgaatgccacgatcgagagctttgcaaatgaggcacttcgcactctgtgccttgcttacattgaagttgcacaagggttctcagctaatgatgcgattcctgaagaggggtacacatgcattggcattgttgggattaaagacccagtgcgcccgggtgtgaaggaatccgtcgccatctgcaggtcagccggtattactgtcaggatggtcacaggcgacaacattaacacagcaaaggcaattgcccgggaatgtggcattctgactgaaggtggtcttgccattgaaggcccagattttagaactaagagtgcagaagaaatgttcaaattgataccaaagatacaggtaatggctaggtcttcaccacttgacaagcacaccttagtgaagaatctccggactacacatgaagaagttgttgcggtgactggtgacgggacaaatgatgcacctgcacttcatgaggctgatattggacttgcgatgggcattgctggaactgaggttgcgaaagagagtgccgatgtcatcattcttgatgacaacttctccaccatagtcacagttgccaaatggggtcgatctgtgtacatcaacattcagaagtttgtgcagtttcaactgacagtcaacgtggttgccctcgttgtgaacttctcgtcagcctgcttgacagggagtgctcccctcactgctgttcagttgctgtgggtcaatatgatcatggacacactcggagcattggcattggccacagaacctccaaacgatgaactgatgaagaggactcccgttggaaggaaaggaaacttcattagcaacattatgtggaggaacatcatgggacaggcaatctaccagttctttgtaatttggtatctgcagaccgaaggaaagacgttgtttgaacttaagggtgataattccgatctagtcctgaacacgctcatcttcaattgctttgtgttctgccaggtgttcaacgaggtgagctccagagagatggagaggataaatgtattcaaaggcattctagacaacaacgtgtttgtcgcggtgctcggcagcacggtcgtattccagatcatcatagtacagttccttggcgactttgcgaacaccacccctctgtcgctcagggagtggttctcctgcattgtcatcggcttcataggcatgcccatcgccgcgatagtcaagctcttcccggtgggttctcagtaggagacgccagctaatttgcagtcaggaactgaagtgaggtggtaggactacaggctgacggcgatgccaacgcagtttgggcgctgtggtgagcataagaaactcttctttctgctgttattaatccgttttatttatctaggtgaattgaatctatggccttctttttcttttgcatttgatctttagaggatgagccaagactgtgggctcgattcttcaaaagtgctttaatagacccttgatagttattttttcatgttgtttatgttggaacctgaaattgtatatgcatcatttgatataagcttgcaccaacctaaagtacttgagaca

SEQ ID NO: 325 - DNA, 3173 bp, Secale cereale
aaaggctgcacttcagttcattcatggtcttgctccccagagtgagtacacagtccctgcagccgtcaaggcagcaggctacggcatctgtgctgaggaactgagctctgttgtcgagagccacgacatcaagaagctgaaagcacatggcggcaccgagggcctcctatcaaaggtgtctacctcagagtcggatggcctcagcacatcacaggacaagcttgcatcccggcaggagatctttggcatcaacaaattcgccgagacagaggcccgcagcttctgggtctttgtctgggaggcgctccaggacatgacactcatgatccttgctgcatgtgccttcttctcactcgtcgtcggcattgccaccgaggggtggcccaagggcgcgcatgatggcctcggcatcgtggctagtattcttctggttgtgtttgtcactgcgacaagcgactaccggcaatccctgcagttcaaggaccttgacaaggagaagaagaagatcacggtgcaggtcacccggagtgggtaccggcagaagctctcaatatacgagcttctcgttggtgacattgtgcacctttccattggtgatcaagtaccagctgacggtttgttcgtatcaggattctcgttgctgattaatgaatcaagcctgactggggagagtgaaccagttgctgtcaatgccgagaacccattccttttgtcaggaactaaagtgcaggatggttcttgcaagatgcttgtgacgacagtcggcatgaggactcaatggggtaaactcatggccaccctcagtgaaggcggggatgatgagacgccattgcaggtcaagctgaacggcgttgcaaccatcattggcaaaataggcctcgtctttgctgtcgtcacatttgcagtgctcactgaaagcctgttccgccgcaagatcatggatggttcatacttgagttggagtggagatgatgcgctggagctgcttgagttctttgctattgctgttactattgttgtcgtagcagttcctgaaggcttaccgctcgccgtgaccttgagccttgcatttgccatgaagaagatgatgaatgacaaggcacttgtccgacaccttgcagcttgtgagaccatgggctcagcaacctccatttgtagtgacaagactggcacactcacaacaaatcacatgactgtcgtcaaggcttgcatctgtggcaaaattaaagaagtggataaatcttcagacaccaagagcttattctctgagctaccggattctgtcatgacaatgctctcgcagtccatatttaacaacactggtggcgatgttgtcatcaaccaggatggcaaacgcgaaatactgggcacaccaaccgagacagcaattctagagcttggcctgtcactcggtggagatttccaggcagtccgaaaagcaaccaccctcctcaaagtcgagccatttaactcagcgaagaagagaatgggagtggtcatccagctgccagggggcgctttccgtgctcactgcaaaggtgcatcagagatcatattggcatcttgcaacaagtacctgaatgatcaaggcaatgccgtcccccttgacagtgcaactattgctcacttgaataacacgattgagagctttgcaaatgaggcacttcgcactctgtgccttgcttacattgaagttgcagatgggttctcagttaatgatgcgattcctgaagaggggtacacatgcattggcattgtcgggattaaagacccagtgcgcccgggtgtgaaggaatctgtcgccatctgcaggtcagccggtattactgtcaggatggtcacaggcgacaacattaacacagcaaaggcaattgcccgggaatgtggcattttgactgaaggtggtcttgccattgaaggcccagattttagaactaagagtgcagaagaaatgttcaaattgataccaaagatacaggtaatggctaggtcttcaccacttgacaagcacaccttagtgaagaatctccggactacacatgaagaagttgttgccgtgactggtgatgggacaaatgatgcacccgcacttcatgaggctgatattggacttgcgatgggcattgctggaactgaggttgcaaaagagagtgccgatgtcattattcttgatgacaacttctccactatagtcacggttgccaaatggggtcgatctgtgtacatcaacattcagaagtttgtgcagtttcaactgacagtcaacgtggttgccctcgttgtgaacttctcgtcagcttgcttgacagggagtgctccccttactgctgttcagttgctctgggtcaatatgatcatggacacactaggagcattggcattggccacagaacctccaaacaatgaactgatgaagaggacccctgttggaaggaaaggaaacttcattagcaacgttatgtggaggaacatcatgggacaggcaatctaccagttctttgtaatttggtatctgcagaccgaaggaaagacgttgtttgaacttaagggtgataattcggatctagtcttgaacacgctcatcttcaattgctttgtgttctgccaggtgttcaacgaggtgagctccagagagatggagaggataaatgtattcaagggcattctagacaacaacgtgttcgtcgcggtgctcggcagcacggtcatattccagatcatcatagtgcagttccttggcgacttcgcgaacaccacccctctgtcactcaaggagtggttctcctgcattgtcatcggcttcataggcatgcctatcgccgcgatagtcaagcttttcccggtgggttctcagtaggaggtgccagctaatttccagtcaggaactgaagtgaggtggtaggactacaggctgatggcgatgccaacgcagtttgggcaccgtcgtgagcataagaaactcttctttctgctattaattaatccgttttatctaggtgatgaattgaatctatggcctttttttcttttgcatttgatctctagaggatgagccaagactgtgggcttgattcttcaaaagtgtttaatagacccttgtagttatttttttctatgtttttttcccttggaatgtcggaacttgaaattgtatatgcatcatttgatataag

SEQ ID NO: 326 - DNA, 4203 bp, Cocos nucifera
gaaacaagaaagtacatgaactggtgaaggaaaccgggatgaagaaacccacgcgctcccaccgcaacaaaagaacaaatagtgataaagttttgggaaagtagaagctaagttcccaaagctctcaccaagccaacttcccaaaactctcaccttaggccctcatcatgcattggttccggtctgtttccaaaatcctaggaaattttgccactaacccttcctcccaacttatttcggatccaatctccttccccaccgccccacgcacccccctcttctctctcctctgctctcccctgttctcaagttctctaatttttccctcttccccgacgcttctcagcaacttcaaggatatatagaagccgtgggacatcgctttgtcagcatcgacatggaagcttctgccaagattccatcttgcatcctttccacacgctttggtcatctttgttgaagcccttttaaaaaaggaggaagagggcttccgcaggagctcgaggaggtggaagtgtggaagaaagattggattttgcgaagggagagtggaaatggagacctatctgaagcacaactttagtggggttaagtccaagaactcgtcggccgaggcgctcgagcgatggcggaaggtctgcggcgttgtcaagaatcccaagcgccggttccgcttcaccgccaacctgtccaagcgcaacgaggcggccgccatgaagagaaccaacaaggagaagttgcgggttgctgttttggtttcaaaggctgcacttcagtttatacagggtgtcccattatctagcgaatacactgtacctgaagaagtcaaggcagcaggctttcaaatttgtgctgatgaattaggttccattgttgaaggccatgatgtgaagaagttgaaaatgcatggcggtatagatggcattgcaaacaagctttgtacatcaacaactaacggacttgttgctgctgaggataggttgatacgcaggcaagagatttatggaataaacaagtttactgaaagtccagttcggagcttctgggtatttgtatgggaagcccttcaggacatgactcttattattcttgctgtctgtgcctttgtatctctgattgttggcattgccacggaaggatggccaaaaggtgcacacgatggccttggcattgttgcaagcattcttctagttgtctttgtcactgcgatgagtgactaccggcaatctttacagttcaaggatttggataaggagaagaagaagatatccatacaagttatgcgggatggattcagacagaagatgtcgatatatgatcttcttccgggtgacattgtgcatttagcaattggagatcaagtccctgctgatgggttgttcatctctggattctctgtattgattgatgaatccagtttaacaggagagagtgaaccggtcattgtaaataaagaaaatccttttcttttgtctggaactaaggtgcaagatggatcttgtataatgttggtgacagctgttggtatgagaactcaatggggtaagctgatggccacacttagtgaaggaggagatgatgaaactccattgcaggtcaaattgaatggagtggcaactatcattgggaaaatcggtctgttctttgcagttgtgacatttgcagtgcttgcagaaggccaaattagatgcaaaattctagatggttcatacttgagctggtcaggagatgatgcattggagttgttggagttttttgccattgctgtgacaatagttgttgttgcagttcctgaagggctgcccttagctgtgaccttgagccttgcttttgccatgaagaagatgatgaatgataaagcgctagtacgccatcttgctgcttgtgagactatgggatcagcaacatccatctgcagtgataagacaggtacattaacaaccaatcacatgactgttgtgaaggcttgtatatgtggagatatcaaggaagtaagtaaccctgagaaggtgagtagtatgggctcccaacttccagatgttgtagtgaaaattcttctgcagtctattttcaataacaccggtggagaagttgtggtcaaccaagacggaaagcttgaaattcttggaacaccaaccgagtctgctttgttggagtttgccttgtcacttggtggagattttcaggcagtgcgtcgagaaactaaacttgtaaaattggaacctttcaattccacaaagaagagaatgggggtggttctccaacttccagaaggaagactccgtgcccattctaaaggtgcttcagaaattatattggctgcttgtgataaggttttagatcctgcaggtaatgctgttccccttgatgcagcagcagtccgtcatctcaatgatacaattgaaagctttgctaatgaagctcttcgtacattgtgccttgcctatatggaaattgagaatagtttctcagctgaggaacaaattcctattgaaggatatacttgtatcggaattgtgggtattaaagatcctgtccgtccaggcgtgaaggagtcagttgcaatttgtaggtctgctggagtaactgtgagaatggttactggagataacataaacacagcaaaggctattgctcgtgaatgtggtattcttactgatgacggggtagctattgaaggaccagagttcagagagaagagtctagaggaaatgaatgatttaattccaaaacttcaggtgatggctagatcttcaccattagacaaacataccttggtgaaacacctgcgcacaatgttcaatgaagttgttgctgtgactggtgatggcacaaatgatgctccagcacttcatgaggcggatattggacttgctatgggtattgcaggaactgaggtggcaaaagagagtgctgatgtaatcattcttgatgacaacttttctactattgtaacggtggcaaaatggggacgttctgtgtacataaatattcagaagtttgtgcagttccagttgactgttaatatggttgctcttgttgttaatttctcttcagcctgcttaacaggaaatgctcctttaaccgctgttcagctgctttgggtcaacatgatcatggatacacttggagctctggctttagccactgagccaccaaatgaaggcttaatgaaaagagctcctgttggaaggaaggggagctttatcagcaatgtgatgtggagaaatatactgggacaagccttctatcagtttatcataatatggtatctccagacagaagggaaagggctatttcaacttgagggccctgattctgatcttacactgaatacacttattttcaattcatttgtcttttgtcaggttttcaatgagattagttctagagagatggagaaaataaatgtgtttcaaggcatcttggagaactatgtgtttgtggctgtcattaccactaccgtcatcttccaatttgttattgtgcaattccttggagattttgccagcacaatcccacttacattcaatcagtggatttttagcgtgttcatcggttttcttggcatgcctattgctgctgccatcaaaatgattcctgtgggatccaggtgaaagatcaacaatgacaaaaactggtgcctgcggagtgtttgtaagatttcaaggccttttcaggtggccaactccatgggctttttcatcactggggtggtagaaacaaccatcaagcaagtcgcgcagaaaggccatgaaaacaggaaaataatctgctcatatttttaagtttgtcttaacaatctgtatgaaactcattctgtgctggacgtaggcctagaaatctggcagccttggatttttaaggcagctgtttgtgaaagaagggtcaaatttccctataacccattcttttcgattgttaagtgatgaattttgaactcgtagaaaggcttggtaacagttatcctgttaccctccatatgttttcttgatttgctctgtatctgcttggaaaggaatgaaagatggactcctgttaactgacctatgaatcattattattgtttgtttctttcatttctgtgtttttctttccataataatttacttgtcctcacactacttaaattttgatgcttatatatgtcctcacacctcagggttgtggctcagagatgaatcagtttacaaccgaataaga

SEQ ID NO: 327 - DNA, 3625 bp, Cocos nucifera
aaggaaacaagaaagtacatgaactggtgaaggaaaccgggatgaagaaacccacgcgctcccaccgcaacaaaagaacaaatagtgataaagttttgggaaagtagaagctaagttcccaaagctctcaccaagccaacttcccaaaactctcaccttaggccctcatcatgcattagttccggtctgtttccaaaatcctaggaaattttgccactaacccttcctcccaacttatttcggatccaatctccttccccaccgccccacgcacccccctcttctctctcctctgctctcccctgttctcaagttctctaatttttccctcttccccgacgcttctcagcaacttcaaggatatatagaagccgtgggacatcgctttgtcagcatcgacatggaagcttctgccaagattccatcttgcatcctttccacacgctttggtcatctttgttgaagcccttttaaaaaaggaggaagagggcttccgcaggagctcgaggaggtggaagtgtggaagaaagattggattttgcgaagggagagtggaaatggagacctatctgaagcacaactttagtggggttaagtccaagaactcgtcggccgaggcgctcgagcgatggcggaaggtctgcggcgttgtcaagaatcccaagcgccggttccgcttcaccgccaacctgtccaagcgcaacgaggcggccgccatgaagagaaccaacaaggagaagttgcgggttgctgttttggtttcaaaggctgcacttcagtttatacagggtgtcccattatctagcgaatacactgtacctgaagaagtcaaggcagcaggctttcaaatttgtgctgatgaattaggttccattgttgaaggccatgatgtgaagaagttgaaaatgcatggcggtatagatggcattgcaaacaagctttgtacatcaacaactaacggacttgttgctgctgaggataggttgatacgcaggcaagagatttatggaataaacaagtttactgaaagtccagttcggagcttctgggtatttgtatgggaagcccttcaggacatgactcttattattcttgctgtctgtgcctttgtatctctgattgttggcattgccacggaaggatggccaaaaggtgcacacgatggccttggcattgttgcaagcattcttctagttgtctttgtcactgcgatgagtgactaccggcaatctttacagttcaaggatttggataaggagaagaagaagatatccatacaagttatgcgggatggattcagacagaagatgtcgatatatgatcttcttccgggtgacattgtgcatttagcaattggagatcaagtccctgctgatgggttgttcatctctggattctctgtattgattgatgaatccagtttaacaggagagagtgaaccggtcattgtaaataaagaaaatccttttcttttgtctggaactaaggtgcaagatggatcttgtataatgttggtgacagctgttggtatgagaactcaatggggtaagctgatggccacacttagtgaaggaggagatgatgaaactccattgcaggtcaaattgaatggagtggcaactatcattgggaaaatcggtctgttctttgcagttgtgacatttgcagtgcttgcagaaggccaaattagatgcaaaattctagatggttcatacttgagctggtcaggagatgatgcattggagttgttggagttttttgccattgctgtgacaatagttgttgttgcagttcctgaagggctgcccttagctgtgaccttgagccttgcttttgccatgaagaagatgatgaatgataaagcgctagtacgccatcttgctgcttgtgagactatgggatcagcaacatccatctgcagtgataagacaggtacattaacaaccaatcacatgactgttgtgaaggcttgtatatgtggagatatcaaggaagtaagtaaccctgagaaggtgagtagtatgggctcccaacttccagatgttgtagtgaaaattcttctgcagtctattttcaataacaccggtggagaagttgtggtcaaccaagacggaaagcttgaaattcttggaacaccaaccgagtctgctttgttggagtttgccttgtcacttggtggagattttcaggcagtgcgtcgagaaactaaacttgtaaaattggaacctttcaattccacaaagaagagaatgggggtggttatccaacttcctgaaggagaacttcgtgcccattctaaaggtgcttcggaaattatattggctgcttgtgataaggttttagatcctgcaggtaatgctgttccccttgatgcagcagcagtccgtcatctcaatgatacaattgaaagctttgctaatgaagctcttcgtacattgtgccttgcctatatggaaattgcaaataatttctcagctgaggatcaaattccagttgaaggatatacttgtattgctattgtgggtattaaagatcctgtccgtccaggcgtgaaggagtcagttgcaatctgtaggtctgctggaataactgtgagaatggttaccggagataacataaacacagcaaaggcgattgctcgagaatgtggtgttcttaccgatgatggaatagctattgaaggtccagagttcagaaataagagtctagaggaaatgaatgatttaattccaaaacttcaggtaatggctagatcttcaccattagacaaacatacgttggtaaaacacctgcgcaccatgttcaatgaagttgttgctgtgactggtgatggcacaaatgatgctccagcacttcatgaggcggatattggacttgctatgggtattgcaggaactgaggtggcaaaagagagtgctgatgttattattcttgatgacaacttttcaaccattgtaaccgtggcaagatggggacgttctgtgtacataaatattcaaaagtttgttcagttccagttgactgttaatgtggttgctctcattgttaatttctcctcagcctgcttaacaggaaatgctcctttaaccgctgttcaacttctttgggtcaacatgattatggatacacttggagctcttgcattagcaactgagccacctaatgaaggcttgatgaaaagagctcctgtaggaaggaatggaaattttatcagcaacataatgtggagaaatatcctgggacaagccttctatcaatttattgtaatctggtatctccagacagaaggaaaagggctatttcaactcgaaggccctgattctgatattactcttaatacacttattttcaattcctttgtcttttgtcaggttttcaatgagattagctctagagatatggagaaaatagacgtgtttcatggcatcttggagaactatgtgtttgtggctgtcattaccactaccgtcatcttccaatttgttattgtgcaattccttggagattttgccagcacaatcccacttacattcaatcagtggatttttagcgtgttcatcggttttcttggcatgcctattgctgctgccatcaaaatgattcctgtgggatccaagtgaaagat

SEQ ID NO: 328 - DNA, 4032 bp, Chelidonium majus
agttctgctcatccaaatttacattaaaaataaagttaaagcaggaatgcaggatcgaggagagagagaaaatggaattatagagtttgaccttccctttctttcaaacagtcctacccttctccaaaccaagcactctaatccaaggttttcggttctggattcgaaaaaatggcaaggtagagaaccactccctctctctctccgctcttaactcgttcactttctatttctcatcatatttcggatccatttcctctctctcttcttcttcatttggacaaacccacaaatcatccatctgctttgatctgtactttttctggtttcaataccctactctgtctgtttcctagaaaaagcagaaaaaaaaaatgacccacataacgactaaataatataacgcgtgaagcagagagattcagaataagtcaccctggaaagatctactgtaaattgttgggaaagagggagttgaatgatttttgaaattctacgtatgattcttgacttgggttcttagtatttgaatgagttgagaggtgtgttggaattttcaatcttgggttttttctacgattaagttgaagaagagatagagatatggagagttatttgaatgagaattttggtggagttttagcaaagaattcatctgacgaagcacttcagagatggagaaaggtttgtgggttcgtcaagaacccaaagagaaggtttcggtttactgccaacctttccaaacgttacgaggcagaggctatgcgtaaaaccaatcaggagaagttgagagttgctgttttggtttcaaaagctgcacttcagtttatccatggtataaccttacccagtgaatacattgtacccgatgatgtcaaagctgcggggtttcaggtttgtgctgaagaattgggtaatgttgtcgaaggccacgatgtgaagaagttgaaagtgcacggtggggtggagggtatagcaaacaagctctgcacatcaactaccactgggcttagcactgatgccgatttgttgaatcgcaggcaggaactttatgggatcaacaaattcactgaaagccaacaacgaagttttttggtatttgtatgggaagcccttcaagatactactctgatcattcttggtgtgtgcgccttcgtatcactaatcgttggaattgttatggaaggatggccaaagggggcccatgatggtcttggaattgttgcaagtatcctattggtcgtgtttgtcactgcgactagtgattacagacaatctctacagttcaaggatttggacaaggagaagaagaagatctccattcaggttacgaggaatgggtacaggcagaagctttcaatatatgatcttcttcctggtgatatagtgcatcttggaattggagaccaggtcccagcagatgggctgtttatatcgggattttctgtgtcgataaatgaatccagtttaacaggagaggctgagcctgtgatggtgagttctgattatccctttctattgtctggaaccaaagttcaagatgggtcatgcaagatgctggtgactacagttgggatgagaacccaatggggtaagttgatggctaccctcagtgaaggaggagatgatgagactccattgcaggtcaaactgaatggcgttgcaaccatcattgggaagataggcttgttctttgctgttgtgacctttgctgttttagtacagaccttgtttacccgtaagctgagagatggaacctatttgagctggtctggagacgatgcattagaaatgctggagtactttgccattgcagttaccattgttgtggttgcagttcctgaggggctacctttggcggtgaccttgagccttgccttcgccatgaagaagatgatgaacgataaagcgcttgtccgccatcttgcagcttgtgaaactatgggatctgccacaagtatttgcagcgacaaaactgggacgctgactaccaaccacatggctgttgtgaaagcatgcatctgtggaaacatcaaggaaattaacaattcaaaggaggctcttactttgtgctctgaaatccctgatgattctgtaaagactcttctccaatcgatatttaccaacacagggggagaagttgtgattaacaaagatggaaaacaagagattttgggttcaccgacagagaccgcccttctagagtttggcttgtctcttggtggagactttcaggcagagcgccaagcatgcaaaattgtaaaagtcgaacctttcaattccgagaagaagagaatgggagtagtgctagagctccctgaaggaggtctccgggcccattgcaaaggtgcttcagaaatcattttggctgcatgtgacaaggttatagatccaaagggtgaagttattccccttgatgaatcttccatcaaccatctgaacgatgtaattgagcagtttgctggtgaagctcttcgaactttatgccttgcatatatagaaatgggaaatgaattctcctgcaaagaaccaattcccctgaaaggttacacttgcataggtattgttggtattaaagaccctgtccgtcctggagtcagagaatctgttgcaatttgtaggtctgccgggatcactgtgaggatggttacaggagacaacataaccactgcaaaggcaattgctagggaatgtgggattcttactgatgggggtatagccattgaaggtccagtatttcgggagaagagtttggaagaattgcaagaactaattccaaaaattcaggtgatggctcgatcttcacccctggacaagcataccttggtgagacacttacgaaccacatttgatgaagttgttgcggtgactggtgatggtacaaatgatgctccagcgcttcatgaagcagatattggacttgcgatgggtatcgccggaactgaggtggccaaagagagtgctgatgttataattttagatgacaatttctccacaattgtgactgtggccaaatggggacgctcggtttacataaacattcagaagtttgtacaatttcaactgacagttaacgtggttgctctagtagttaatttttcttcagcatgcttgactggaaatgcccctctcacagctgttcagcttctatgggtcaacatgatcatggatacactgggagcacttgcactggccaccgagcctcctaatgacgaactaatgaagagaaccccagttggaagaagagggaattttatcagtaacgtgatgtggaggaatatcatggggcaatctctttatcagtttgtggtaatatggtatctccaagttgcagggaaatcattgttcaatctcgatgggcctgaatctgatctgattctgaacacactgatatttaactcatttgtcttttgtcaggtttttaatgaaataagctccagggaaatggagaagattgatgttttcaaaggcatactggaaaacaacgtattcgtggctgtgctcactgccaccgtcgtctttcaaattataatcatcgaattccttggtacatttgcaaacacctctccactcacttatcaacaatggttcttcagtgtattcattgggttccttggaatgccaattgctgccttggtcaagatgatccctgtgggtatatgaagttcaggcaggtaggattgaaacatcaccagcgctttcccactcttgcgtggatgtcataccacttaaaaccagctttctgttttcccttgcatcgaccgcacattggaacaaacgattcttctagaacctgaaagagcatgctcgcaaaagcaagggattgtgtgctccctttgttgctgcgatatgctcacaattttttgtagacagcttatgtattcaattatagaattaaactactattctaggggaggggaaatagggaaagctttgtaccaaccttcttagtttcaaatgagaaggatgaaaatctaacaattcccccatttcttttagtttctacatctatgtattaactgattcgatgat

SEQ ID NO: 329 - DNA, 3425 bp, Ananas comosus
tgaagtcgaagcactcctcggatgaggtgctgcagcggtggcggaagctctgcggcgtcgtcaagaaccccaagcgccgcttccgcttcaccgccaatctctccaagcgctccgaggcccgggcgatgaagcgctccaaccaggagaagttgcgggttgctgttttggtttcaaaagctgcacttcagtttatacatggcattacattgcatagcgagtacactgtaccagctgaagtaaaggctgcgggcttcgagatatgtgccgaggaattaagttcaatcgtcgaaggccatgatctgaagaagttaaaagcgcatggtggtgtagctggtgtagcggacaagctatccacatcaacaaatgatgggcttattactcaggaggatagaataacagtgaggcagcagatatacggaataaataagttcgctgaaagccaagccaggagcttttgggtgtttgtatgggaagcacttcaagatatgaccctcattattcttgcagtgtgtgccttggtttccttaatcgtagggattgctaccgaaggatggccaaaaggtgctcacgatggccttggcattgttgcaagtattcttttagttgtctttgtcacagcaacaagtgattatcgccaatctttgcagttcaaggatttggataaggagaaaaagaaaatatctatacaagttactcgagatggatttcgacagaagatatcaatatatgatcttcttcctggtgatgtagtacaccttgctataggagatcaggtcccaactgatggtttgttcatatccggtttctctttattaattaatgaatccagtttgacaggagagagtgaacctgtggctgttagtacagaaaatcctttccttctatctgggactaaggttcaagatggttcctgtaaaatgttagttaccactgttggcatgagaacccaatggggtaagctaatggccacacttagtgaaggtggagatgacgaaactccattgcaagtgaaattgaatggagttgctactattatcggaaaaattggtctattttttgctgttgtcacatttgcagtgttaagtgagggcctaatccggcataaattccgagatggttcatactttagctggtctggagatgatgcattggagttgttggaatttttcgcgatcgcagttactatagtagttgttgcagttcctgaagggcttccactcgctgttactttaagccttgcttttgccatgaaaaaagtgatgaacgataaagcacttgttcgccacctcgcagcgtgtgagactatgggttcagccactaccatttgtagtgataagacaggaacgctaacgaccaaccacatgactgttgtaaaggcttgcgtatgtggaaatatcaaggaagtaagtaattctaaggaagctattagtatttgctctgatattccagattctgttgtgaaaattttgctgcagtctatatttaataacactggtggagaggttgtgactaaccaagatggtaagcttgagattcttggaacaccaacagaaacagctttactagaatttgggctgtcactgggtggaaattttcaagttgttcgcaaggaaagtagccttatcaaggttgagcctttcaattctctgaaaaagagaatgggagtggtgcttcagcttcctggaggcatatatcatgcccatactaaaggtgcttcggaaattatattggctgcttgtgataaagtattggactctacaggtaacgctgttcctcttgatgaaacagcggttagtcatctcaagggtacaattgaaagctttgctaatgaagcacttcgtactctttgccttgcgtatatggagattgaaaatggtttctcagttggggaacaaattcctttaagtggatacacttgtattggaattgtgggtattaaagatcctgttcgacctggtgtaaaggaatcggttgctatttgtaggaatgcgggtattacagtgcgaatggtaacgggagataacataaatacggcaaaagcgattgctcgagaatgtgggatacttacggatgatgggctagctattgaaggcccagaattcagaacaaagagtctagaggaattaaatgctttgattccaaaacttcaggtgatggctagatcttcaccgttagataagcataacttggtgaagcatctgcgcaccacattcgatgaagttgttgccgtgactggggatggtacaaatgatgctccagctcttcatgaggcagatattgggcttgcaatgggtattgcaggaactgaggtggcaaaagaaagtgctgatgtcattattctcgatgacaacttttcaactattgtcaccgtgggaaaatggggacgatctgtgtacataaatattcagaagtttgtgcagtttcagctaaccgttaatgtggtagctctaatcgtgaatttctcttcggcatgcttaacaggtaatgctcctctaactgctgtccagctgctttgggtcaacatgatcatggatacacttggagcacttgcgttagctactgagccgccgaataatgatctgatgaaaagagctccagtcggaaggaaaggaaatttcattagcaatgtgatgtggaggaatattctaggacaagccttatatcagtttgtcgtgatatggtatctccagaccgaaggaaaagggctgtttcgacttgagggcctgaactctgatgctacactgaatactcttatattcaattctttcgtgttttgtcaggtttttaatgagatcagctccagagagatggagaagatcaatgtattcgagggcatcttggagaactgcgtattcgtggctgtgattgtgagcaccgtcatcttccaatttataatcgtccaattccttggagattttgcgaacacgaccccactaacctttatgcagtggttcactagcatcttcgtcggctttctcagcatgcctatcgctgctgcagttaaattaatccctgttgacgcctaataataaatcggtagtagcacgaaaactaaatttgtagttagcaggagtgtggaatttttttttcctaaaatgtctatttttctcttcacgatcattgtatgtgcatttttacccatttttttggtgcttttgagagctaaccatcccaagttgataactatatattgtactcagaagggtcagatctccctattaggatttttctttttctttttttcttttttttggtttacatggtaatgctgaaactatatcaggctgggcaacagctgccactgcctcaatgtaattcccttctcgctttaattgagtaatgtttcttttgcaaacttgcccaagagaagaataatgcatggatctgaccaagtggtttcgttttaatattgacaaacagatagg

SEQ ID NO: 330 - DNA, 3409 bp, Aquilegia formosa
atctatggagagttacttgaatgaaaatttcggaggagttaaaccgaaaaactcatcagatgaagcacttgaacgatggagaaagctttgtggatttgtcaagaatcctaaacgtcgtttccgatttactgctaatctttccaaacgttatgaagctcaagctatgcgccgaactaatcaggaaaaattaagggttgccgttttggtttcaaaagctgccctccagtttatccatggtataacattatcaagtgaatataatgtacctgaggaagtcaaagcagctggatttcagatagatgcagaagagttgggatccattgtcgaaggtcacgatgtaaagaagttaaaagttcatggtggggtggaaggtattgtagataagctttgtacatcaacagccaacgggctgaccactactggagatttactcagtcgcaggcaagaaatttatggaattaataaatttactgaaagcgaagtacggagtttttgggtgtttgtatgggaagcccttcaagacatgactctaatgattcttggtgtctgtgcatttgtttcactgattgttggcttaattatggaaggatggccaaagggagcacacgatgggcttggaattgctgcgagtatacttctggttgtatttgtcacagcaacaagtgactatagacaatctctacagttcaaagatttggacaaggaaaagaaaaaaattacgattcaggttacaaggaatgggtaccggcagaagatctcaatatacgatctacttccaggtgatatcgtgcatcttgccattggggaccaagtcccagcagatggactgtttgtttcaggcttctctctgtcaataaatgaatccagtttaaccggagaatcagaccctgtgatggtaaatgcccaaaatccttatatgttatcaggaaccaaagtccaagatggttcatgcaagatgttggtgaccaccgttggaatgagaacccaatggggtaagttgttggctaccctcagtgaaggaggagatgatgagaccccattgcaagtcaaactgaatggagtagctacaatcattgggaagataggccttttctttgcggttgtaacctttgcagtcttggtccagggcctatttagccgtaagtggcaggatggaacctacttgtggtggtctggagatgatgctttagcattgttagagttttttgctgttgcagtaactatagttgtggttgcagtccctgaggggcttccattggctgtgactttgagtcttgcctttgccatgaagaagatgatgaatgataaggcacttgttcgtcatcttgcagcttgtgagaccatgggctctgccacaagcatttgtagtgacaaaactgggaccctgaccaccaatcatatggctgttgtaaaaacatgcatatgtgggaaggttaaagaaatgaatagttctgatgaggttttcaccttgtgctctgaagttccaagtactactttgaaaacccttctccaatcaatatttaataacactgggggggaggttgtggttaacaaaaatggaaagcgtgagattttgggaacacctaccgagactgctttgttggaatttggtttgtctcttggtggagactttaaggcagagcgtgagtcagccaaacttgtaaaagttgagcctttcaattctgagaagaagaggatgggggtggttttagagcttcctgaaggaggactccgtgcccactgcaagggtgcttcagaaataattttggatgcttgtgacaagtttatagattcaaatggtgaagttgttcgtcttgatgaagctacattgaatcatcttaacaatacaattgaacagtttgctaatgaagctcttagaactctttgccttgcttacatggaactaggaaatgactactctgataaggattcgataccacttaaaggctacacttgtattggtatagtgggtatcaaagatcctgttcgccctggtgtcaaagaatctgttgcaatttgcaggtctgctgggattaccgtgcggatggttactggagataatataaacaccgcaaaagcaattgctagagaatgtggtattctgactgatggtggcattgccattgaaggtcctgtgtttcgggagaagagtttggaagagttgcaggaaataattccaaaacttcaggtgatggctcgatcttcgccactagataagcatacgttggtgaagcacttgagaaccacttttggtgaagttgttgcggtaactggtgatggtacaaacgatgctcctgcactgcatgaagcagatattgggcttgcaatgggcattgctggaacagaggtggcaaaagagagtgccgatgtcataattctagatgacaatttttccacaattgtgactgtggccaaatgggggcgttcagtttacatcaacattcaaaaatttgtacagtttcaactgactgttaacgtggttgcgctgattgttaatttttcttcagcatgcttgacaggaagtgccccccttacagctgttcagctattgtgggtcaacatgatcatggatacactaggagcacttgcattggccactgaaccccctaatgatgaattaatgaaaagaaccccagttggaaggaaagggaattttatcagtaatgtaatgtggagaaatattttgggccagtctctgtaccagtttgtcgtgatatggtatctccagacgaggggaaaggcattgttcagtcttgatggtcccggatccgacctgatactgaacactttgatttttaactccttcgtcttttgtcaggtttttaatgagataagctccagagagatggagaagatagatgtttttgagggcattctggacaacaatgtgtttgtgactgtgctttctgcaacttgcatctttcaaattatcatcattgagtttcttggtacatttgcaaacacccatccactctcgttttcacagtggtttcttagtgtttttcttgggttcttgggcatgcccatcgccgctgctgtcaagatgatccctgtaggagtgtaggatctacataagaactattactactacagaagtgcttttgatttttgtacaaggccttcccccgtaaatccagtccacggtaggtcttccaagacctgaaagtacatgcttggcagggtagagactgaagacttcattcacttatgtaaccaactttgaaattgaattcaattgttattttgatcctaacatagggaagtgaaaggatttactgtgaaaagaaaaggtgatgactgatgatcaagatccctaaatctactgttattgtatgcttatcagtaccagaatagtttgatctattattgattttgccaatggattagaagtatgaatttctacacaaaa

SEQ ID NO: 331 - DNA, 3176 bp, Triticum aestivum
ctgttgtcgagagccacgacatcaagaagctgaaagcacatggcggcaccgagggcctcctatcaaaggtgtctacctcagagtcggatggcgtcagcacatccaaggacaagcttgcatcccggcaggagatctttggcatcaacaaattcgccgagacggaggcccgcagcttctgggtctttgtctgggaggcgctccacgacatgacactcatgatccttgctgcatgtgccttcttctcgctcgtcgtcggcattgccaccgaggggtggcccaagggcgcgcatgatggcctcggcatcgtcgctagtattcttctggttgtgtttgtcactgcgacaagcgactaccggcaatccctgcagttcaaggaccttgacaaggagaagaagaagatcacggtgcaggtcatccggagtgggtaccggcagaagctctcgatatacgagcttctcgttggtgacattgtgcacctttccattggtgatcaagtaccagctgacggtttgttcgtatcaggattctcgttgctgattaatgaatcaagcctgactggggagagtgaaccagttgctgtcaatgccgagaacccattccttttgtcaggaactaaagtgcaggatggttcttgcaagatgcttgtgacgacagtcggcatgaggactcaatggggtaaactcatggccaccctcagtgaaggcggggatgatgagacgccattgcaggtcaagctgaacggcgttgcaaccatcattggcaaaataggcctcgtctttgctgttgtcacatttgcagtgctcactgaaagcctgttccgccgcaagatcatggatggttcgtacttgagttggagtggagatgatgcactggagctgcttgagttctttgctattgctgttactattgttgttgtagcagttcctgaaggcttaccgctcgccgtgaccttgagccttgcatttgccatgaagaagatgatgaatgacaaggcgcttgtccgacaccttgcagcttgtgagaccatgggctcagcaacctccatttgcagtgacaagactggcacactcacaacaaatcacatgactgtcgtcaaggcttgcatctgtggcaaaattaaagaagtggaaaaatcttcagacgccaagagcttattctccgagctaccggattctgtcatgacaatgctctcgcagtccatatttaacaacactggtggcgatgttgtcatcaaccaggatggcaaacgcgaaatactgggcacaccaactgaggcagcaattttagagcttggcctgtcactcggtggagatttccaggcagtgcgaaaagcaaccaccctcatcaaagtcgagccatttaactcagcaaagaagagaatgggagtggtcatccagctgccagggggtgcattccgtgctcactgcaaaggtgcatcagagatcatattggcatcttgcagcaagtacctgaatgatcaaggcaatgccgtcccccttgacagtgcaactgttgctcacttgaatgccacgattgagagctttgcaaatgaggcacttcgcactctgtgccttgcttacattgaagttgcagatgggttctcagctaatgatgcgattcctgaagaggggtacacatgcattggcattgttgggattaaagatccagtgcgcccaggtgtgaaggaatctgttgccatctgcaggtcagccggtattactgtcaggatggtcacaggcgacaacattaacacagcaaaggcaattgcccgggaatgtggcattttgactgaaggtggtcttgccattgaaggcccagattttagaactaagagtgcagaagaaatgtacaaattgataccaaagatacaggtgatggctaggtcttcaccacttgacaagcacaccttagtgaagaatctccggactacacatgaagaagttgttgccgtgactggtgacgggacaaatgatgcacccgcacttcatgaggctgatattggacttgcgatgggcattgctggaactgaggttgcaaaagagagtgccgatgtcattattcttgatgacaacttctccactatagtcacggttgccaaatggggtcgatctgtgtacatcaacattcagaagtttgtgcagtttcaactgacagtcaacgtggttgccctagttgtgaacttctcgtcagcttgcatgacagggagtgctccccttactgctgttcagttgctctgggtcaatatgatcatggacacactaggagcattggcattggccacagaacctccaaacgatgaactgatgaagaggacccctgttggaaggaaaggaaacttcattagcaacattatgtggaggaacatcatgggacaggcaatctaccagttctttgtaatttggtatctgcagaccgaaggaaagacgttgtttgaacttaagggtgataattccgatctagtcttgaacacgctcatcttcaattgctttgtgttctgccaggtgttcaacgaggtgagctccagagagatggagaggataaatgtattcagaggcattctagacaacaacgtgttcgtcgcggtgctcggcagcacggtcttattccagatcatcatagtacagttccttggcgatttcgccaacaccacccctctgtcactcagggagtggttctcctgcatcgtcatcggcttcataggcatgcctatcgccgcgatagtcaagctcttcccagtgggttctcagtaggagatgccaactaatttgcagtcaggaactgaagtgaggtagtaggactacaggctgatggtgatgccaacgcagtttgggcgctgtcgtgagcataagaaactcttttttctgctgttaatccgttttatttatctaggtgaattgaatctatggccttttttttcttttgcatttgatctttattagaggatgggccaagactgtgggcttgattcttcaaaagtgtttaatagacccttttagttattttttcatgctattttccttggaatgttggaacttgaaattgtatatgcatcaacctaaacctaaagtacttgggacatctgtttgattcgacatgatgtttggattggcttgtgtataaggtttccctgttgccatctttgtgccttttattgtccagtgccagaaatttagccg

SEQ ID NO: 332 - DNA, 3727 bp, Papaver somniferum
actacgttccagttacttgacttttttgattaaagtatttgaataagagaagtataagtttctgattttcctgaagaaggagaagaggaaagaaaggatggagagttatttgaatgagaactttggaggtgtattagcgaagaactcatctgaagaagcacttcaaagatggagaaaactatgtggatttgtcaagaatccaaaacgaaggtttcgtttcactgcaaatctttcaaaacgttacgaagcagaagctatgcgacgtacaaatcaggaaaaattgagagttgcagttttagtgtcaaaagctgctcttcagttcattcatggtgtaacatttcccacggaatacattgtccccgacgatgtcaaagctgcaggatttcagatttgtgcagaagaactgggttcagttgttgaaggccatgatgtgaagaagttaaaagtgcatggtggggtggagggtatagcaaacaagctttgtacatcaaccaccactgggctatctgcagatgcagatttgttggatcgcaggcagggcctctatggtatcaacaaattcactgaaaaccaattgagaagtttctgggtattcgtatgggaagcgctacaggatacaactctcatcattcttgctttttgtgcttttgtatctctgatggttggtatagctactgaaggatggccacagggagcgcatgacggtcttggtattgttgcaagtattctgttggttgtatttgttactgctacgagtgactatcgacaatctctacagtttaaggatttggacaaggaaaagaagaagatttccatgcaagttacaaggaacggatacagacagaagatgtcaatatacgatcttctccctggtgatatagtgcatcttggaatcggagatcaggtcccagcagatgggctttttatatctggattttcattgtcgataaatgaatccagtttaacaggagaagccgagcctgtgatggtgagtgctgatcatccttttctgttatctggaaccaaagttcaagacggatcatgcaagatgctagtgactacagttgggatgagaacccagtggggtaaattaatggctaccctcagtgaaggaggagatgacgagactcccttgcaggtcaaactgaatggtgttgccaccattattggtaagataggattgttctttgctgttgtgaccttcgcggttttggtgcagaccctatttacccgtaagatcagagatggaacccattggagctggactggagatgatgcattagaaatgctggaatattttgccattgcagttactattgtcgtggttgcagtccctgaagggttacctttggcagtgactctgagccttgcgtttgctatgaagaagatgatgaatgataaggcacttgtccgtcaccttgcagcttgtgagactatggggtctgcaacaactatatgcagtgacaaaactgggacactgactaccaatcatatggctgttgtgaaagcatgcatttgtggaaatatcaaggaaataaacagcccaaatgaggcacttagtctgtgctctgaaatccctgatgctgctgtgaagacccttctgcaatccatatttactaacacgggtggagaagttgtgataaaccaagatggaaaacaagaaattttgggttcacccactgaaactgctattttggagtttggcttgtctcttggtggagactttcaggcagagcgtggagcagccaaaactgtaaaagtcgaacccttcaattctgagaagaaaagaatgggagtagtactagagcttcctgaaggaggtctccgggcccattgtaaaggtgcttcggaaataattttggctgcatgtgacaaggttatagaccccaggggcgaagttgttccccttgatgaaattacaatcaaccgtctcaatgatactattgagcagtttgctggtgaagctcttcgtactctatgccttgcttatatggaaatgggaactgattattccgccaaggatccaattccacttagaggctacacttgcataggcattgttggtatcaaagatcctgttcgtcctggtgtcaaggaatctgttgcaatctgtagagctgctgggatcatggtgaggatggttacaggagacaacataaccactgcaaaggcaattgcaagggaatgtgggattttgactgatgatggcattgctattgaaggtccagtatttagggagaagagtttggaagaattagaaaaactaattccaaaaattcaggtgatggctcgatcttctcccctggataagcacatgctggtgagacatctaagaaccacattcggtgaagttgttgctgtgactggcgatggtacaaatgacgctccagcgcttcatgaagcagatattggacttgcaatgggtattgctggaactgaggtggcaaaggaaagtgctgatgttatcattttagatgacaatttctccacaattgctacagtggccaaatgggggcgttccgtttacattaacattcaaaagtttgtacagtttcagctgactgttaacgtggttgctctaatagttaatttcacttcagcttgtttgactggaagtgcccctctcacggctgttcaattgctatgggtcaacatgatcatggatacacttggagcacttgcactggccactgagcctcctaatgaggaactaatgaagagaactccagttggaaggacaggcaattttatcagtaatgtgatgtggaggaacatcatggggcaatctctttatcaatttgctgtaatatggtatctccaagtcgcaggaaaaacagtattcaatcttgatgggcctgaatctgatctgattctgaatacactgatattcaactcattcgtcttctgtcaggttttcaatgaaataagttcaagggagatggaaaagattgacgtatttaaaggcatattggagaactatgtgtttgttgctgtcctcagttgcactgttgtgtttcagatcattatcattgaattccttggtacatttgcaaacacctctccgctcaccttaacacaatggttcttcagtgttttcattggattcctaggaatgccaattgctgctgttgtcaagatgatccctgtgggaatataggaaaaccaggcaacgcatgaaacatcagaagtgctttctgtctcttgtctataaacgccatcattctattaaaagccgttttgacttgcaacgacgacaagctaatggaactaatgactcctctataacctgaaatagcaagattgcaaagctggggttgatgaagctccctttgttgctgcaatgctcacgattttttgtaggcagctttcggatatttatagaattattgccaaaaaacatacggatggtgaatatgtgaaagttgtacaccaaccttgcttggttttttgagtcaggagggtgacaatttaactgttcccccatttcttttagttctacattgaacacttttaagtgggtctatgagatccttctaatgagtattgtggcatggagctttattattagtattgtggcatagctacacctagaaattctggtttcttgaagatctggagaacgaaaattctggttccttggtagtgaactagtgattaggataagggtttatattagcttaaactgtattaaacatttctacatcagctcacctcagacaattcgaat

SEQ ID NO: 333 - DNA, 3982 bp, Amborella trichopoda
gggctgtttccaaaagagcagggccttctctgcaactactcattatgtctctctctcatctaatcgatccactaattcgccattctctctctccaatctttgcctttctctctctctcctatctttgatcagacagaaagctacaccttacccaacattccacaacattcgattgcttcaatttcaggcacttctcagtcactagaagccatctccatttttgcgaggccattaaaacccatttgttgcttttgcggctaaagctgacatttttcagatacacggtggaaatgaccaggatccatgtttggtcaaaggaaatttcactgtagtttcccctgctatactgcttttgaaaaagcacgcggtttcgtacatttcggacccttgcttttgtatatttgaaccttgggtttgaaggttttgagactttgatagagagagaagcaagaatggagagctaccttaatgagaattttggaggggtgaggcctaagcactcttcggaggaggctctgaggcgatggcgaagactctgtggcatcgtgaagaacccgaaacgaagatttcggttcaccgcaaacttgtcgaagagatcggaggcccaggccatgcgcaagaccaatcaggagaagttaagggttgctgttttagtctcaaaagctgcacttcagtttatcaatgggattacgttttccggtgaatatattgtacccagtggagtaaaagctgccggttttgggatttgtgctgatgagttgggttccattgtcgaaggacatgatgttaagaaactcaaagtccatggtggcatcgaaggtttagcaaacaagctttctacatcaaccactgatgggattattacaactgatgataataaactgaaaactagacaagaaatttatggggtcaatagattcactgaaagcccacctcgtggcttttgggtctttgtatgggaagccctccaagacatgactcttatgatccttgcagtgtgtgcctttgtatctttgcttgttggaattgccactgagggttggccaaaaggtgcccatgatggcattggaattgtactgagcatattactggtggtttttgtcactgcaactagtgattatcgccagtctctacagttcaaagatttggacaaggaaaaaaagaagatatcaattcaggttacaagaaatgggtataggcaaaagctctcgatatatgatttgcttcctggtgatattgttcatctctctattggagaccaagtccctactgatgggctttttatctttggattttctgttctgatcaatgaatcgagtttaacaggagagagcgaaccagtaactgtgaacaaagacaacccatttcttctttctggtactaaggtccaagatggctcatgcaagatgcttgtaacaactgttggtatgagaacccagtggggcaaactaatggcaactctcagtgaaggtggggatgatgaaactccattgcaggtcaagttgaacggtgtggccacaatcattgggaagattggattgttctttgctgtaattacatttgctgtgttggttcaaagccttctaagcaagaagatccaagagggtcggcaatggatatggactggagatgaggccctggaaatgttggaatattttgctattgcagtgaccattgttgttgtggcagttcctgaaggcttgccattggctgtcactttgagtttggcatttgccatgaagaaaatgatgaatgataaggcactggtcaggcaccttgccgcctgtgaaacaatgggctcagctactggaatttgtagtgataaaacaggtacactaaccaccaaccacatgactgttgtaaaagcttgcatttgtgggaatattaaagaagtgggtagctctgaggaagctcgaaacatgtgctctcatatccctgattctgccctaaaacttcttctggaatcaatttttaacaatacaggcggtgatgttgtgataacccaagatggaaaacttgagattttaggcaccccaactgaaactgctattttggagtttgggttatcccttggtggtaattttgaggcagagcgccaagaatgctcacttttgaaagttgaacctttcaattctgcaaagaagagaatggctgttgtcatccaactgccaaatggagaattaagggcccattgtaagggtgcttcggaaataattttggatgcttgtgataaggtcatagacccaactggtaaggttgtccccctcgatgaagcgactatgaaccatctcaagaataccatcgaaagctttgctagtgaggcccttcgtacattgtgccttgcgtatgttgaactggagaatagctttccaattggggatcaaatcccattggatggttatacatgtattggtattgttggtattaaggatcctgttcgccctggtgttaagcagtctgttgagatttgtaggtcagctgggattactgttaggatggtaacaggagacaacataagtacagcaaaggccattgctagggaatgtggaattctgactgatggtggggtggcaattgaaggcccggaatttcgcaaaaagagtcaggaagagttgaatgaactgattccaaaaattcaggtgatggcacgatcttcacctctagataaacataccttggtgaaacagcttcgtaccacattcaatgaagttgttgctgtaactggtgatggcacaaatgatgcaccagccctccatgaggcagacattggacttgcaatgggaattgctgggactgaggtggcaaaggagagtgcggatgtcattatattggatgataatttctccactattgtgactgtagccaaatggggccgttccgtatacaccaacatccaaaagtttgtgcagtttcagttgacagttaatgtggttgccctaattgtgaacttttcttcagcctgcctgacaggtaaagccccacttactgctgttcagcttctttgggtgaacatgattatggatacattaggggcacttgcattagccactgagccccctcaagatgaccttatgaaaagagccccagttggaaggaaagggaattttataagcaatgtgatgtggaggaacattttaggccaagctgtatatcagttcaccgtgatacgttatctccaaacagaaggaaaagggatttttcgactggctgggccggatactgatcccgttttgaatactctgattttcaactcattcgtcttttgccaggttttcaatgagataaactccagagagatggagaagatcaatgtgttcaaaggcatattggacaactatgtatttgtggcggttctctcatgcacagtcgtgttccaagtcataattattgaatacctcgggacttttgcaaacacaatcccacttacattgacccagtggtttgccagtattctgattggattcctagggatgccaattgctgcaatgattaagaagatccctgtctgaagaaacaaagcaaaatgaggtgacagcatctctgaagatcgaaggggttcaccaaaaaaaaaaaatggtgtgttccatgtagtttatttttgaggtccacaaggaaaatgtgcagagaaaaccagtaattttggtatgttaggatagggctttactaatgtgggatgagatattcaaagttttgtttattttgctgatcagacctttttgtatatgcatctgattcatttgtttatgctactgtatatgttgaaaccgagagggttttggatcttaactttcttgatgtctgcatcctaggatcctcttaaaccgagagggttttttatcttaactttcttgatgtctacattctcttaatgtatgcttactttttatagagaacaagaggcattttaaatgaaatcatgtgccaatttattgctacatgcaaaaagtggcgactaaaggaacctaagaaattttcagttttt

SEQ ID NO: 334 - DNA, 3561 bp, Musa acuminata
tgactccacaattcctggtcgcttcctccaaatgcatggaaactatgccaccactccccctcccttcagtatatttcggatcgacgtctctttccccttcttcctaccttcctccttccctcctccctcctccatgaactttattcttcaccttcctttctcctcctacatcgcagtcttgtcgtagaaaccgcgaagaagttttgagcttttgaggcctttattggaagcgagcccttcactcgggacttggctacaagtagccactggagaagaggaggaagaggaggaaggggccgaggaggcaggatggagagctacctgaacgagaacttcggtggggtgaagtcgaagaactcgacggaggagtcgctcgagcgatggcggaagctcgtcggcgtcgtcaagaaccccaagcgccgcttccgcttcaccgccaacctctccaagcgctccgaggccgccgccatgaagcgctcgaaccatgagaaattgcgagtagctgttttggtttcaaaagccgcattgcaatttattcatggtatcgcattgcatagtgagtacattgtgcctgatgaagtgaagaaagcaggcttccaaatttgccctgatgaattgggttccatagttgaaggccatgatgtgaagaagttgaaagtccatggtggtgttaatggtattgcggacaaactttcaacatcaacaacaaatggactaattgctacagaggagagtttgaaacacaggcaagatatttatggagtaaataaatttactgaaagccaggttcggagtttttggatatttgtttgggaagcacttcaagacatgactctcataattcttgctgtgtgtgcttgtatatcccttattgttggcattgccacagaaggatggccaaaaggtgcacatgatggacttggcattgtggctagcatactgttggttgtctttgttactgcaactagtgattaccgacaatctttacagttcaaagatttggataaggagaagaagaagatatctgtacaggttacacgtgatggcttcagacagaagatttcaatatatgatcttcttcctggtgatctagtgcatcttgcaattggagatcaagttcctgctgatgggttattcatgtctggattttccttattgatcaatgaatccagtttaacaggagagagtgaacctgtcaatgtgaatgctgacaatccatttcttttatctggaactaaagtccaagatggatcttgtaaaatgctggtaactacagttggcatgagatcacaatggggtaagttgatggccacccttagtgaaggaggagatgatgaaactccattgcaggtcaaactgaacggagttgccactatcatagggaaaattggcttggtatttgcagttgtgacatttgcagtgcttgctgaaggactaatcaaacataagtttcaacatggttcatacttgagctggtcagcagatgatgcattagagttgctggagtattttgctgttggagtcactattgtagtggttgcagttcctgaaggattgcctttagctgtaaccttgagccttgcttttgccatgaaaaagatgatgaatgacagagcactggtccgccatcttgctgcttgtgaaactatgggttcagctacatctatttgcagtgacaagacaggtacattgacaaccaatcacatgactgttgtgaaagcttgcatatgtgggaatatcaaggaggttaataatcatgaagaaataaaacatgtttgctcccaggttccagatgttgctctaaaagtactcatgcaatccatcttttataacactggcggtgaagttgttatcaaccaagctggaaaacttgaaatacttggaacgccaactgagactgctctgttggaatttggattgttactaggtggggatttccaggttgcacgtcaggagactaagattgtcaaagtggaaccatttaattctgaaaagaagagaatgggagtggttctccagcttccaggaggaggatacagagcccattgtaaaggtgcttcagaaattatattggctgcttgtgataaggttttagattctgcaggtaacactgtcctgcttgatgaatcaacattcagtcaactcaagagtactatagaaagttttgccagtgaggctctccgtacactgtgccttgcttacatggaaattgagaatggtttcacagctgatgaacaaatccctattaatggattcacttgtattggaattgttggcatcaaagatcctgttcgtccaggtgtaaaagattcggttgcaatttgcaggtctgccggaattactgtgagaatggttacaggggataacataaacactgcaaaggctattgctcgagaatgtggtattcttactgatgatggggttgctattgaaggtccagacttcaggagtaagagtctggaggaaatgatggatttaataccaagacttcaggtgatggctagatcttcaccaatggataaacataccttggtgaaacatctgcgcaccatgttcaatgaagttgttgctgtgactggtgatggcacaaacgacgctccagcacttcacgaggcagatattgggcttgcaatgggaattgcaggaactgaggtggctaaagaaagtgctgatgttattattcttgatgacaacttctcaactattgtaactgtggcaaaatggggacgttcagtgtacataaacattcaaaagtttgtgcagtttcagctgactgttaatgttgttgctttaattgtaaacttctcctcagcctgcataaccggacatgctccgctaactgccgttcaactgctctgggtgaacatgattatggatacacttggggcactcgcattagccactgagccaccaaatgatgaattgatgaaaagatctcctgttggaagaaaaggcggttttattagtaacacaatgtggaggaacatcctaggacaagccttgtaccagttcattgtgatatggtatctccagagagaagggaaagggctgtttcaacttgagggccctgattctgatcttgcactaaacactcttattttcaattccttcgtcttttgtcaggtattcaatgagatcagctgcagagaaatggaaaagatcgatgtgttccatggcatattggagaattatgtattcgtggctgtcatcacctgtaccatcatcttccagttcataatcgttcagttccttggagaattcgcgaacaccactccgttgactttatatcagtggtttgcctgtgtgttcattgggtttcttggtatgcctatttctgctgccatcaagatggttcctgtgggttccaagtaaggaatcagagtcttaggagatttccctaatcatctaacaacagatttttgtgtgtcaatagctatctccatggattttgtaatgttgtcgattgtagaggataccatggagccagttgcaagaacattctattagaacataactgtcttttcgatgctttttttttctcttaacctttatggcagaggc

SEQ ID NO: 335 - DNA, 2808 bp, Sorghum bicolor
caccccctccgccctccctctcgtcgtcctcccgcaacaacacgaggggggaggcgtggccgcggcagccggtttgacccgcccgcgagcttataaagcggtttctccggggaacgtcttgtcacgcaagtcgctcgagttttcccgcgccggctgcctccgcctgcttcctcggtctcagattcccgcgttcgaaagcgagggaccggacggcgccggcggagtacgccttctttctttcgttcattccctgtccttgtctctcgtgctctccgtccgttccgttccggcaaaagcggcgcgcgaagatagtctgggaatcgctgttcgtttcttgattccggcggcggagcggaggccctgcatgtgagggcggccccgcgcgcggcctcggattcggacagagcgaccgtctcccgacgtcgccgtcgccgtcgccgccgccgccggcggccgaccgatggagacggtgaaggggtgggtggcggccaactacgcggaggccatggcgtcgatgcagcactcgctgcgcgtcgcctacgtcgtcttctccttctgcgccgccttcttcctcggcggcatcaaagcgatggtggtcggacccgttgccgccgcgctgatgatagtgggcaacgtcggcgtcatactcgtcctcttcccggcgcacgtctggtggacaatctactcgctcgtcaagactgaccgcgtcaacacgggcctgaaattagccgtgctcttcacgctgcccgtgctgttcggcctctggctggggctcggcatcttcggcagcgcgctggtggctctcgggtacggcttcttcacgccgtggatctccaccttcgaggcgttccggcaggaaagcgaggccaagaagttcgtgcacggcattgtggacgggacgtggggcacgatcaagggcagctgcacggtggttagggacttcgccgacatatgcttccactcctaccccgtctacctcaaggagctgcgcgagagctgccagaatcgtgagccccattccataaggttgctggatgtgccctcatgtatagttgttgctctcctggggctaatcgttgacataccgctttacacagtgattgcactaatcaagagcccgtatatgctcttcaaaggctggcagaggctgctgcatgaccttataagccgagaaggcccgttccttgaaacagtttgtgtgccaatcgctggccttgctatccttttctggccactggtggtagttgggagtgttctgttggctatcgtctcgagcatttttgtggggctctacggagcagtcattgttttccaggagaagtcatttcaaaggggagtttcgtatgttgtggccatggttgcagagtttgatgagtacaccaatgactggctttacctccgcgaaggaactgttctcccaaagccgtcctatagaaagagaaaatcatccaactccacagaattctcagtgagaacaaatgcctctgtcaaaggaactggtcctagtgaagcaccggcaatgttggtcccgaatttggctcctgcaagatcagtaagagaggctatacaggaagtcaaaatggtccagatatgggaaaacatgatgaagtcatgcgaacagaggggcagggaccttctgaacctgaatgtcataacaaccgccgccctgacagagtggttaagggcaaaggagagcagccacgagaccataagcctgggcctgccttcgtactccctgctgtgcaccgtgctgcaatcgatcaaggccggctccggagggctggtactgggcaacttcgaggtgaaccagcacaacaggccccaggaccggctgctggactggttcttccaccccgtgctggtgctgaaagagcagatacaggcgctgaagatgaccgaggaggaagtgaggttcctggagaagctgaccgtcttcgttggcaacgccgctgccagcgctggtgggtgggataatggtgtccagatgccccaggatcctgtgaggttggcacagattcaggccatcagtagaaggctggttggaattgtgaggagcatgtcgaagttcccgacgtacaggaggagatacaggaacgtcgtgaagctgctcatcgcctactccatcgagagggaaagctcgtcggcttcagggcactcggcttcctactttgagataacacaactggatgtgtaatttatgggaagcaagcaatttccaattgtaattaagctgtttctagaatcaggtagatccagttccttttgtttttgtctcccccttcagtaaatataatctttcgcacgccgttgttagtgccttcgtgtgtttcaattcaagcctagtgaggtttttgtagaacactagtcgtcgttacaggagataggcgctccttgtccattgcagatgctgatcaagcgtgttcacgtgccaaagcttcagagttcagacttattaaagccagccgctgcactgcttgcacaattgtagtacacattttcttttgtactgtatatagcctgtcgatccaatgcacctgtgctgttcttttatttatctcttgcagcctcttgtcacacggttcgtcgagtgcctgtcgaaagctggcacggtggcacctggcattacagcagcaagcgaatggtagcgtctgccggctggctgccggtgctgaaaccaaacaaaaatcttgggcatgtgcaagcgtgccccgacttggaagtaaccagatccagctcagctgccatccagaaccaaaccaacagccggatcagcctcatccgttcctggcaataaagtgtaaaacaccc

SEQ ID NO: 336 - DNA, 2553 bp, Setaria italica
aaaaaataatcccaaaaaaaacaaggcaggcaaaacccctcgaaccttctctcccctccccctcctctgctcccgcaagaacacccaacacgagcgcgagcgcggccgccggtttgacccgcccgcgagcttataagcggtttctccgggagcgtctagtcgcgcaagtcgctcacgttgtcccgcgccggccgcctcctccgcctgcttggccggtctcggattcccgccagcgaaagcgagaagaggagaggagagggggcgcttcttttccctgtccgcctctttctcttgtgctctccgtccgttccgcaaaaggggcgcggcgatagtttgggggagtcgcttcgttttcttgattccagcggcggaggcgtggttcgcccgttcgttcttggcggcgacggaggcggaggcgcgggggccgtggatgtgagggaaggcctccgacagagctgcagtcgcccgacggcggcgacgatcgatggactcggcgaaggcgtgggtggcggccaactacgcggagcccatggcgtcgatgcagcattcgctgcgcgtcgcctacgtggtcttctccttctgcgccgccttcttcctcggcggcatcaaagcgatggtggtcggccccgtggccgcggcgctgatgatcctgggcaacgtcagcgtcatactcgtgctcttcccggcgcacgtctggtggacaatctactcgctcatcaagactgaccgcatcaacgcgggcttgaaattagccgtactcctcgcgctgccggttttgttcggcctctggttggggctcagcatcttcggcggcgcgctggtggcgctcggctacggcttcttcacgccgtggatctccaccttcgaggcgttccggcaggagagcgaggccaagaagttcgtgcacggcattgtggatgggacgtggggcacgatcaagggcagctgcacggtggttagggacttcgcggacatatgcttccactcctaccccgtctacctcaaggagctgcgcgagagctcccataatcgtgagcctcattcaataaggctgctggatgtgccttcatgtatagttgttgctctccttgggctagtcgtggacataccgctttacacggttatcgcgctgatcaagagcccctacatgctcttcaaaggctggcagaggctgctgcacgacctcatcagccgtgaaggcccgttccttgaaacagtttgcgtgccgatcgctggcctggccatccttttctggccactggtggtggttgggagcgtcctgttggctattgtctcgagcattttcgtgggcctctacggagcagtcattgtcttccaggagaagtcgtttcaaaggggagtttcatatgtggtggccatggtagcggagtttgatgagtacaccaatgactggctttaccttcgtgaaggaacaattctccctaagccttcctacagaaagaggaaatcatccaactccacagagttctcagtcagaacaaatgcctctgtcaaaggagctgaatatccttctggttccggtgaagcaccagcaatgttggttccgaatttggctcctgcaagatcagtaagagaggctatacaggaagtcaaaatggtccagatatgggagggcatgatgaaggcatgcgagcagaggggcagggaccttctgaacctgaatgtcattacggccgtcggcctgagcgagtggctaagggcaaaggaaagcggccatgaaaccataagcctgggcctgccttcttactccctgctgtgcaccgtgctgcaatcgatcaaggccggcgccggagggctgttgctgggcaacgtcgaggtcaaccagcacaacaggccccaggaccggctgctggactggttcttccaccccgtgctggtgctcaaggagcagatacaggcgctgaagatgaccgaagaggaagtgaggttcctggagaagctgaccctcttcgttggcaacgccgcgagcactagcgtgtgggataacggcgccgagatgccccaggatcctgtgaggttggcacagattcaggccatcagtagaaggctggttggaatcgtgaggagcctgtcgaagttcccgacgtacaggaggaggtacaggcacgtcgtgaagctgctcatcgcgtactccatcgagcgagacggctcgtgcagatcctcggcgtcgagccactcggtttcattcttcgaaataacgcagctcgatgtgtaatttccacagcaatctcgaagtgtaattaagccatctttaggatcagatagctcccggttttttcgttccttttcagtaaatatcgcacgccgttttgtcagtgccttttgtgtatttcaagcctagcaaggaggtttctgtacactagagtagtcgactagtcgcatcaacagaaaggcgccatttgcgcagatgctgatcaggcgttcacgtgccgaaacttcagacaaaagtcagccgctgcactgcagaattgtacatttcttttttgtttatagcttgtcgatccaaatccaatgcacatgtgttgttctcct

SEQ ID NO: 337 - DNA, 2676 bp, Panicum virgatum
ggcggcttccacggggacgggcttgtcgcgcaagccgctcacgttttcccgcgccggacgccgcctccggctgcctgctcggtctcggattccctcgacccaaagcgagaagaggagaggaccggcggggcgggcgcttgttttcctgtccgcctctttctctcgtctcgcgctctccgtccgcgacgatagtttggggggagagtcgcttcgtctcttgattccggcggcggaggcgtggttcgcccgtaagtccttggcggcggcggaggcgggggccgtcgatgtgagggagtcctctggcagcagagcgtccgtcggcggcgggcggcgggcggcggcggcggcgatcgatggactcggtgaaggcatgggcggcggcaaactacgcggagcccatgacgtcgatgcagcagtcgctccgcgtcgcctacgtggtcttcgccttctgcgccgccttcttcctcggcggcatcaaagcgatggtggtcggccccgtggccgcggcgctgatgatcctgggcaacgtcggcgtcatactcgtgctcttcccggcgcacgtctggtggacaatctactcgctcatcaagactgaccgcatcaacgcgggcctgaaactggccgtgctcctcgcgctgccggtcctgttcgtcctctggctggggctcggcatcttcggcagcgcgctggcggcgctcggctacggcttcttcgcgccgtggatctccaccttcgaggcgttccggcaggagagcgaggccaagaagttcgtgcacggcattgtggacgggacatggggcacgatcaagggcagctgcacggtggttagggacttcgcggacatgtgcttccactcctacccggtctacctcaaggagctgcgcgagagctcccaggatcgtgagccccattcgataaggttgctggatgtgccttcatgtatagttgttgctctcctggggttggtcgtggacatatcgctctacacggtgatcgcgctgatcaagagcccctacatgctcttcaaaggctggcagaggctgctgcacgacctcatcagccgcgagggcccgttccttgaaacagtttgcgtgccgatcgctggcctggccatccttttctggccactggtggtggttgggagcgtcctgttggctatcgtatcgagcattttcgtgggcctctacggagcagtcattgtcttccaggaaaaatcgtttcaaaggggagtttcatatgtcgtggccatggttgcagagttcgatgagtacaccaatgattggctttacctccgtgaaggaacaattctcccaaagccttcctacagaaagaggaaatcatccaactctacagagttctcagtcagaacaaatgcctctgtcaaaggcgctgaatatccttctggttccagtgaagcaccagcaatgttggttccgaatttggctcctgcaagatcagtaagagaggctatacaagaagtcaaaatggtccagatatgggagaacacgatgaaggcatgcgagcagaggggcagggaccttctgaacctgaatgtcataacggccgtcggcctgtccgagtggctgaggggaaaggaaagcggccacgagaccataagcctgggcctgccttcctactccctgctgtgcagcgtgctgcaatcgatcaaggccggcgccggggggctgctgatgggcaacgtcgaggtgaaccagttcaacaggccccaggaccggctgctggactggttcttccaccccgtgctcgtgctgaaggagcagatccaggtgctgaacatgacggaggaggaggtgaggttcctggagaagctgaccctcttcgtcggcaacgccgcgagcgctagcgggtgggacaacggcgccgaggtgccccaggatcccgtgaggctggcgcagattcaggccatcagtagaaggctggtcgggatcgtgaggagcctgtccaagttcccgacgtacaggaggaggtacaggcacgtcgtgaagctgctcatcgcgtactccatcgagagggatggctcgtgcaggtcgtcggcgtcgaaccactctgtttcgttcttcgaaataacacaggtcgacgtgtaaatttcggagcgatcccgaactgcaattaaagccatcttaggatcagatagctccagtttttttcgttctttcttttttcttcagtaaatatcgcacgccgttttgccagtgcctgccctttgtgtatcttaagcctagtaaggaggtttctgtactagacttagtcgacttgtcgtcgttacagacaggagataggcgccattttgcagatgttgatcggacagaggcgttcacgtgccgaaacttcaggcacaagtcagccgctgcaccgcacacttgtacattttttttcttttgtgtatagcttgtcaatccaatgcacatgtgttgttctcttatccctcgaacaaaagctgcgacctttcctcacacggttcatactttctttatcttttatctaacaagaaaaggtccatcgatcgcctgtcgaaagctggcacagtgggcacctggcaccacaggagcaaccgaggaactgagggtgtgtttagttggtgaaaaaatttggatttcggtactatagcatatttcgttgttacttgacaaataatatccaattatggactaatta

SEQ ID NO: 338 - DNA, 2471 bp, Oryza sativa
gcgcgcaacagtgccgccgcggccgccggcaggtttgacccatccaaagccaacccccaaaccgacgaatcaatcaagaacccccccgaatctaaaatctttctttaagagctctccctcccctggagcggcttctcccgcaagccgctgaatttttccaccaccaccggtcgtcgcggattcccgcgacagccagccagcgaggacgcgcgctttctttttcttctttgtttttccctcgtcctctccgtccggctgcagaaaagcttccatctctctgaagctgtccttgattcttgcggaggtagacaggcaggtgtagtcctttgtgtgcccgtgcgtatatgtgagcgagtgctaccgggcgcgtcgacgccggcgacgaacgaacgatcgattcgattcgactcgatggacaaggtgaaggcgtgggcgggggccaactacgcggagcccatggggtcggtggagcagtcgctgcgcgtcgcgtacgtggtcctctccttctgcgccgccttcttcctcggcggcatcaaagcggcggtcgtcggcccggtggcggcggcgctgatggtgctgggcaacgtcggcgtgatactcctcctcttcccggcgcacgtctggtggaccatttactccctcatcaagactgaacgcatcaacgccggcctgaaactagcggtgctcatcgcgctgccggtgctgttcggcctctggctggggctgggcatcttcgggagcgcgctggtcgccctcggctatggcttcttcacgccgtggatcgccaccttcgaggcgttcaggcaggagagcgagtccaagaagttcgtgcatggcgtcgtggacgggacgtgggggacgattaaaggcagctgcacggtggttagggactttgcggatttatgcttccactcgtatcctgtttatctgaaggagctgcgcgaaagctcgcagaattgcgagccccattccatcagggtgttggatgtgccctcatgtatagctgttggtctcttgggattaatcgttgacattccgctctacaccgtaattgcgctgataaagagcccctatatgctcttcaaaggttggcagaggctgcttcatgaccttataagccgcgaaggtccattccttgagacagtttgtgtgccgatcgctggcctggctatccttttctggcctctggtggttgttgggagtgtcctactagctatcgtctcgagcatttttgtgggtctctacggagcagtcgttgtctaccaggagaagtcgttccagaggggagtttcttatgtggttgccatggttgcggaatttgacgagtacaccaatgactggctttatctccgggaagggacagttcttccgaagccttcctaccgtaagagaaaatcgtccagttccacggagttttcagtcagaacgaatgcttctgttaaaggaggcgaccaacctagttccaatgaagctccagcaatgctggttccaactttggccccagcaaggtcagttagagaggccatacaggaagtcaaaatggtccagatatgggaaaatatgatgaagaattgtgaactgaggggcagggatcttctgaatttaaacgtcataacaactgttgatcttactgaatggttacgaacaaaggaaagtgggcatgaagcaataggactgggagtaccttcttattctctgctgtgtatgatcctccattcgatcaaggccggttctggagggctattgataggcaatggcatcgaaatcaatcaatataaccgcccccaagatcggttgatagactggttcttgcaccctgtgctggtgctgaaagatcaaatacaagcgctgaaaatgacggaggaagaagtgaggttcttggagaagctgacccttttcattggtaattctgagagggcaaatgggtgggataatggtgctgaaatcccccaagatcctgtaagggcaggacagatccaggccatcagtagaaggttggttggaattgtaaggagcatgtcaaagtttcctacgtacaggaggagacacaggcacgtcatgaaactgctcgtcacgtactccgtcgagaaggaagggtcgttcagatcatccgcgtcgaatcgatcagtacctatctttgagataacgcaattggaagtgtaattgaaagttgaaaccatattcagaaatcagagtcagataggtcccttcttcaaatggtcttctttcttcagtaaatatcgcacgccgttttgtcagtgcttgtgtttccccaaatctaggaggttttgtatagctttattttttttacaaggagagagatgcctcactccagaacttctcgctgtgagattcatttgccaaaactgcaggcatgaatgaatcatccattgtacatttgtattgtaaattctgtacatactccttgatcagatcagatacacatgcatgttggttcttttaccttttgc

SEQ ID NO: 339 - DNA, 2388 bp, Brachypodium distachyon
tgacccaacccagccagccagccgatcaagaacctaagttataagcacttttcttcccccatacggcttgtcacgcaagccgctgccgagttttctgtctcgccggcactggtcgcagattcccccgcgaaagcaaggacgagcgctttctttgcttcttttcttgctctgtcctctggccttgtgctctccgtccgccctgcaaaagcagcagaaagttcccgtcccggcagctgttcttgattcttgcgggggtcacaggtccagttcgctgttcttgacccgcggcgtgggcgggccagtactgggccgcggcggggcgaccctcggcggcggcggcgacggccgatcgatgggcacggtgaaggcgtgggtggcggacaactacgcggaggccatggcgtcgatgcagaactcgctgcgcgtcgcgtacgtggtcttctccttctgcgccgccttcttcctcggtggcatcaaagcgatggtggtcggcccggttgccgcggcgctgatgatactgggcaacgtcggagtgatactcgtcctcttcccggcgcacgtttggtggaccatctactcgctcatcaagacggaccgcatcaacgcgggcctgaagctggcggggctcatcgcgctgccggtgctgctggggctctggctgggcctgggcatctttgggagcgcgctggtggctctcggctacggcttcttcaccccgtggatctccaccttcgaggcgttccggcaggagagcgacgccaagaagtttgtccatggcattgtggacgggacgtgggggacgatcaagggcagctgcacggtggtgagggacttcgcggacatttgcttccattcctacccggtttacctcaaggagttccgccagtgctcccacaaccggcagccccactccataaggctgttggatgtgccgtcatgtatagccgtcggcctcctggggctggccgtggacataccgctgtacacggtgatagcgctggtgaagagcccctacatgctcttcaagggctggcagaggctgctgcacgacctcatcagccgtgagggcccgttcctcgagaccgtctgcgtgcccatcgcgggccttgccatcctcttctggcccctcgtggtcgtggggagcgtcctcatggccgtcgtctccagcatctttgtcgggctctacggtgcagtcatcgtctaccaggagaagtcgttccggagggggatttcctatgtggtgaccatggtcgcggagtttgatgagtacacgaacgactggctttaccttcgcgaagggacagttcttccaaagccttcctatcggaagagaaaattacccgattctgcggagttctctctccgagcaactgtttctgtcaagggaggtgagcatcctgctgcttccggtgaagcaccggcaatgctggttccagcgttggttccagcgcggtcagtcagggaggccatacaagaggtcaaaatggtccagatatgggaaaacatcatgaagtcatgtgagctgaggggcagggatcttctaaatctaaacgtcataacaaccgttgatctgaccgagtggttaagaacaaaggacggtaacaatgacacaatagacctgggcctaccttcctatgctctgctgtgcaccgtcctccaatcaatcaaggctggttctggagggctactactaggcaacggcgtggaggtcgatcaacagaaccggccccaagacctgttgctagattggttcttccaccctgtgctagtgctgaaagaccaaatacaggtgctgaaaatgcgggaggaggaggtgaggttcttggagaaatcgactcttttcgttggtaattttgcaagcgcaaatgcgtgggataatggtgccgaaatccccaaagatcctgtaaggacagcacagattcaggcaatcagtagaaggatggtcgggatcgtgaggagcatgtcaaagttccccacgtacaggaggagatacaggcacgtggtgaagctgctcgtggcatactccgtggagcgggaagggtccttcggctcatccgattcagcccagtcgatctccttcgagataacacgcctcgatgtatgagttaggaggatcagagatagtcctactcttttgttgcatatttttcttcagtagataccgcacgccgtttttgtctgtgcgtctctgtttcaagtcttgggagcttctgtaattttgtatagctgttgtgaaaaatggggttcaggtcgatccaatgcacatactgtgagatgaccgggatttcagacatgagtcttccatggtgctgtaaatttttgtgtatacttcttttacggagttctgtatatgcagaagccagaagtaattggttcgttagttcttgt

SEQ ID NO: 340 - DNA, 2462 bp, Secale cereale
ctcacgggcgagcgggaacgagagagcgcagccgcccgccgttctgacccgcccagccggcagatcaagaacccttataagcgccttttcttccccatacgcatacggcttctcacgcaagcactccgccagcgccggtcgcagattcccgcgaaagcgagggccagagcttttcttttctatcctctcccccctttgtgctctccgtcctgccaaagcggcagaaagctgcagctgttcttgattcccgcggcacggctcgccggtcttggtggcctggatgtgaaggagccgcggcgcagcggagcggggctatcgatgggcacggtgaaggcgtgggtggcgggcaagtacgcggagcccatggggccgatgcacgactcgctgcgcgtcgcctacgtggtcttctccttctgcgccgccttcttgctcggcggcatcaaagcgatggtggtcggcccggtggcggcggcgctgatgatactggggaacgtgggcgtcatactcgtgctcttcccggcgcacgtctggtggaccatctactcgctcatcaagacggaccgcatcaacgcgggcctgaagctggcggtggccatcgcgctgccggtgctgttcgggctctggctcggcctgggcatcttcgggagcgccctggtggccctgggctacggcttcttcacgccgtggatctccaccttcgaggcgttccggcaggagagcgaggccaagaagttcgtgcatggcattgtggacgggacgtgggggacgatcaagggcagctgcacggtggtgagggacttcgcggacatgtgcttccactcctaccccgtttacctcaaggagctccgcgagtgctcgcaggaccgcgaacccctctccataaggctgctggacgtgccgtcgtgcatactcgttgctctcctggggttgatcgtggacataccgctctacacggtgatcgcgctgatcaagagcccctacatgctcttcaagggctggcagaggctgctgcacgacctcatcagccgcgagggccccttcctggagccggtctgcgtgcccatcgccggcctcgccatccttttctggcccctcgtggtggttgggagcgtcctgctggcggtcgtctccagcatcttcgtgggtctctacggagcggtcatcgtcttccaggagaagtccttccggcggggagcttcttacgtggtgaccatggtcgccgagtttgacgaatacaccaacgactggctttaccttcgcgaaggcactgttcttccaaagccttcctatcggaagtggaaatcgtccgattccgccgagttctcagtcaggccaaatgtttctgttaggggaggtgagcaccccagtgcatcaagtgaagcaccagcaatgctggttccgactttggttccggcgaggtccgtcagagaggcgatacaagaggtcaaaatggtccagatatgggaaaacgttatgaagtcatgcgagcagaggggcagggacctgctgaacttgaacgtcataaccagcgttgacctgaccgagtggctaagaacaaaagacggtggcaacgagacgataaacctggggctgccttcctatgacatgctgtgcaccgtcatgcagtcgatcaaggccggctccgcggggctgctgatcggcaacggcgtcgaggtggatcagcagaaccggcctcaggacctgctgctggactggttcttccaccccgtgctggtgctcaaggaccagatacaggtgctcaagatgaccgagcaggaggtgaggttcctggagaagtcgacccttttcgtcggcagtggctctgctgctactgccagtgccgatgcgtgggataatggcgccgagacgccccgggatcccgtgcggaccgcgcagatccaggcgatcagtagaaggatggtggggatagtgcggagcatgtccaagttcccgacgtaccggaggcgatacaggcatgtggtgaagctgctggtggcgtacgcggtggagcgggaagggtccttcggatcgtcggcgtcggggccgtcggtctccttcgaaatcacacgcctcgaagtgtagataatgccctcgtcttttgcttctttttccacttaagtatataaagtaggtatcgcacgccgtttttgtctgtgcctctgctgtttcaagtctaggaacttctgtacctttgtgtagtactagtagtagtagtttttttaccgttcggtagtgggagtgtgtatagtcgttgtgttttgagatgatgcatgtgcccaaacttgaggcatggtcttcagttgtgctgtaaattcttgtatatacattttcctagggaattgattggttctttagtaggttctgcatctttgtttgtccggctgtgttaactgtggcgagctggcacgatggtaacctatatgagcaagaattcgtcgagtttgacggggccaaaaaaagtc

SEQ ID NO: 341 - DNA, 2446 bp, Secale cereale
cccccccccataataataaatccggaaaggcaaaacccccggaaacttctccccgttcccctctctccctctcccgtcttctcctcgttcgactcaactcacgggcgaacgggaacgagagagcgcagccgcccgccgttctgacccgcccagccggcagatcaagaacccttataagcgccttttcttcccccatacgcatacggcttctcacgcaagcactccgccagcgccggtcgcagattcccgcgaaagcgagggccagagcttttcttttctatcctctccccccctttgtgctctccgtcctgccaaagcggcagaaagctgcagctgttcttgattcccgcggcacggctcgccggtcttggtggcctggatgtgaaggagccgcggcggggcggagcggggcaagcgatgggcacggtgaaggcgtgggtggcgggcaagtacgcggagcccatggggccgatgcacgactcgctgcgcgtcgcctacgtggtcttctccttctgcgccgccttcttgctcggcggcgtcaaagcgatggtggtcggcccggtggcggcggcgctgatgatactggggaacgtgggcgtcatactcgtgctcttcccggcgcacgtctggtggaccatctactcgctcatcaagacggaccgcatcaacgcaggcctgaagctggcggtggccatcgcgctgccggtgctgttcgggctctggctcggcctgggcatcttcgggagcgccctggtggccctcggctacggcttcttcacgccgtggatctccaccttcgaggcgttccggcaggagagcgaggccaagaagttcgtgcatggcattgtggacgggacgtgggggacgatcaagggcagctgcacggtggtgagggacttcgcggacatgtgcttccactcctaccccgtttacctcaaggagctccgcgagtgctcgcaggaccgcgaacccctctccataaggctgctggacgtgccgtcatgcatactcgttgctctcctggggttgatcgtggacataccgctctacacggtgatcgcgctgatcaagagcccctacatgctcttcaagggctggcagaggctgctgcacgacctcatcagccgggaaggccccttcctggagccggtctgcgtgcccatcgccggcctcgccatccttttctggcccctggtggtggttgggagcgtcctgctggcggtcgtctccagcatcttcgtgggtctctacggagcggtcatcgtcttccaggagaagtccttccggcggggagcttcgtacgtggtgaccatggtcgccgagtttgacgagtacaccaacgactggctttaccttcgggaaggcactgttcttccaaagccttcctatcggaaatggaaatcgtccgattctgccgagttctctgtccggccaaatgtttctgttaggggaggtgagcaccccggtgcatcaagtgaagcaccagcgatgctggttccgactttggttcctgctaggtccgtcagagaggcgatacaagaggtcaaaatggtccagatatgggaaaacgttatgaagtcatgcgagcagaggggcagggacctgctgaacttgaacgtcataaccagcgttgacctgaccgagtggctgagaacaaaagacggtggcaatgagacgataaacctggggctgccttcttatgacatgctgtgcaccgtcatgcagtcgatcaaggccggctccgcggggctgctgatcggcaacggcgtcgaggtggatcagcagaaccggccgcaggacctgctgctggactggttcttccaccccgtgctggtgctcaaggaccagatacaggtgctcaagatgaccgagcaggaggtgaggttcctggagaagtcgacccttttcgtcggcagtggctctgctgctactgccagtgccgatgcgtgggataatggcgccgagacgccccgggatcccgtgaggaccgcgcagatccaggcgatcagtagaaggatggtggggatagtgcggagcatgtccaagttcccgacgtaccggaggcgatacaggcatgtggtgaagctgctggtggcgtacgcggtggagcgggaagggtcgttcggatcgtcggcgtcggggccgtcggtctccttcgaaatcacacgcctcgaagtgtagataatgccctcgtcttttgcttcttttttcacttaagtatataaagtaggtatcgcacgccgtttttgtctgtgcctctgctgtttcaagtctaggaacttctgtacctttgtgtagtagtagtagtagtagtttttttaccgttcggtagtgggagtgtgtatagtcgttgtgttttgagatgatgcatgtgcccaaacttgaggcatggtcttcagttgtgctgtaaattcttgtatatacattttcctagggaattgattgg

SEQ ID NO: 342 - DNA, 2138 bp, Triticum aestivum
cgcggcgggggcgatcgatgggcacggtgaaggcgtgggtggcgggcaagtacgcggagcccatggggccgatgcacgactcgctgcgcgtcgcctacgtggtcttctccttctgcgccgccttcttgctcggcggcatcaaagcgatggtggtcggcccggtggcggcggcgctgatgatactggggaacgcgggcgtcatactcgtgctcttcccggcgcacgtctggtggaccatctactcgctcatcaagacggaccgcatcaacgcgggcctgaagctggcggtggccatcgcgctgccggtgctgttcgggctgtggcttgggctgggcatcttcgggagcgccctggtggccctgggctacggcttcttcacgccgtggatctccaccttcgaggcgttccggcaggagagcgaggccaagaagttcgtgcatggcattgtggacgggacgtgggggacgatcaagggcagctgcacggtggtgagggacttcgcggacatgtgcttccactcctaccccgtttacctcaaggagctccgcgagtgcgcccaggaccgcgaacccctctccataaggctgctggacgtgccgtcgtgcatactcgtgggcctcctggggttgatcgtggacataccgctctacacggtgatcgcgctgatcaagagcccctacatgctcttcaagggctggcagaggctgctgcacgaccttatcagccgcgaaggccccttcctggagccggtctgcgtgcccatcgccggcctcgccatccttttctggcccctagtggtggtcgggagcgtcctgctggccgtcgtctccagcatcttcgtgggtctctacggggcggtcatcgtctaccaggagaagtcgttccggcggggggcttcgtacgtggtgaccatggtcgccgagtttgacgagtacaccaacgactggctttaccttcgcgaaggcactgttcttccaaagccttcctataggaagaggaaatcgtccgactccgcggagttctcggtccggccaaatgtttctgttaggggaggtgagcaccctagttcatccagtgaagcaccagcaatgctggttcccactttggttccggcgaggtccgtcagagaggcgatacaagaggtcaaaatggtccagatatgggaaaacgttatgaagtcatgcgagcagaggggcagggacctactgaacctgaatgtcataaccagcgtggacctgaccgagtggctaagaacaaaagacagtggcaatgagacgataaacctgggactgccttcgtatgacatgctgtgcaccgtcctgcagtcgatcaagaccggctccgcggggctgctgctcggcaacggcgtcgaggtcgatcagcagaaccggccgcaggacctgctgctggactggttcttccaccccgtgctggtgctcaaggaccagatacaggtgctcaagatgaccgagcaggaggtgaggttcctggagaagtcgactcttttcgtcggtagtagttctgctactgccagtgcggatgtgtgggataatggcgccgagaccccccgagatcccgtgaggaccgcgcagatccaggcgatcagtagaaggatggtggggatagtgaggagcatgtccaagttcccgacgtaccgcaggcgatacaggcatgtggtgaagctactggtggcgtacgcggtggagcgggaagggtcgttcgggtcgtcggcgtcaggtccgtcggtctccttcgaaatcacacgcctcgaagtgtagataatgccgtcgtcttttgcttctttttcgtcagtatataagtaggtatcgcacgccgtttttgtctgtgcctctcctgtttcaagtctactaggagcttctgtaattttgtgtggtggtagtactttttttttttccctttaggtaatgggagtgtgtatagttgttgtgttgtgagatgatgcgcgtggcatgatcttcagctgtgctgtaaattcttgtatatacattttcctagggaattgtttggttctttaggtgttatacattgttgcatctttgcccggccggctgtgtttactgtggagagctggcatgatggtaacctatatgagcgagaattcctcgagtttgacgggg

SEQ ID NO: 343 - DNA, 2699 bp, Aegilops tauschii
cgcttaccacacggccacggtcactaaactgtctccttgaccgtcaactttgacctcctttcaagctaacgccgttagcaacttactacgtacgtcacggcgcgcaccagtcgaaactatccagacaaacggacaaaactccttccgtcccggcagttaacacctccgcaaaaaatttaaataaatccgaaaggcaaaacccccgaaacttctcccagttcccctctccctctccctctcgcgtcttctttctttctcctcgcaacatttcgtccgactcaactcacgggcgagcgggaacgagagcgcggccgccattttgacccgcccggccggcggatcaagagcccttataagcgccttttcttccccatacggcttctcacgcaagctgagttttttgctccacctgcgccggtcgcagattcccgcgaaagcgagggccagagcttttcttttctatctatcttgctctgtcctctcccccctttgtgctctccgtcccgccaaagcggcagaaagctgcagctgttcttgattcttgcgggggactgccggcacggctcgccggtctgggcggcctggacgtgaaggagccgcggcgcggcgggggcgatcgatgggcacggtgaaggcgtgggtggcgggcaagtacgcggagcccatggggccgatgcacgactcgctgcgcgtcgcctacgtggtcttctccttctgcgccgccttcttgctcggcggcatcaaagcgatggtggtcggcccggtggcggcggcgctgatgatactggggaacgtgggcgtcatactcgtgctcttcccggcgcacgtctggtggaccatctactcgctcatcaagacggaccgcatcaacgcgggcctgaagctggcggtggccatcgcgctgccggtgctgttcgggctgtggcttgggctgggcatcttcgggagcgccctggtggccctgggctacggcttcttcacgccgtggatctcgaccttcgaggcgttccggcaggagagcgaggccaagaagttcgtgcatggcattgtggacgggacgtggggaacgatcaagggcagctgcacggtggtgagggacttcgcggacatgtgcttccactcctaccccgtttacctcaaggagctccgcgagtgcgcccaggaccgcgaacccctctccataaggctgttggacgtgccgtcgtgcatactcgtcggcctcctgggtttgatcgtggacataccgctctacacggtgatcgcgctgatcaagagcccctacatgctcttcaagggctggcagaggctgctgcacgacctcatcagccgcgaaggccccttcctggagccggtctgcgtgcccatcgccggcctcgccatccttttctggcccctagtggtggtcgggagcgtcctgctggccgtcgtctccagcatcttcgtgggtctctacggagcggtcatcgtctaccaggagaagtcgttccggcggggggcttcgtacgtggtgaccatggtcgccgagtttgacgagtacaccaacgactggctttaccttcgcgaaggcactgttctcccaaagccttcctatcggaaagaggaaactgtccgattccgcggagttctcggtccggccaaatgtttctgtcaggggaggtgagcaccctagttcatccagtgaagcaccagcaatgctggttcccactttggttccggcgaggtccgtcagagaggcgatacaagaggtcaaaatggtccagatatgggaaaacgttatgaagtcatgcgagcagaggggcagggacctactgaacctgaatgtcataaccagcgtggacctgaccgagtggctgagaacaaaagacggtggcaatgagacgataaacctggggttgccttcctatgacatgctgtgcaccgtcctgcagtcgatcaaggccggctccgcggggctgctgctcggcaacggcgtggaggtcgaccagcagaaccggccgcaggacctgctgctggactggttcttccaccccgtgctggtgctcaaggaccagatacaggtgctcaagatgaccgagcaggaggtgaggttcctggagaagtcgacccttttcgtcggtggcagttctgctgctgccactgcggatgcgtgggataatggcgccgagaccccccgagatcccgtgaggaccgcgcagatccaggcgatcagtagaaggatggtggggatagtgaggagcatgtccaagttcccgacgtaccgcaggcgatacaggcatgtggtgaagctactggtggcgtacgcggtggagcgggaagggtcgttcgggtcgtcggcgtcaggtgttatacattgttgcatctttgcccggccggctgtgtttactgtggagagctggcatgatggtaacctatatgagcgagaattcctcgagtttgacggggccaaaatctgaaaaatcttgaggagaaacacacgaagcagccagctgctatccactttccccttgcatcgttttttagagaaaaggtctcttcctcttgtgcatcatttattcatcttcttctctgcttgtttttcttttttgagaaacttctgctcttgtgaacccggctagactcgcggggaatcaaggcctgtatgcgtttttttcatttctttttctttgctcttttcgttttttcttcatccaaatatttta

SEQ ID NO: 344 - DNA, 1911 bp, Setaria italica
gcaatgaaaccttgcactggaactggcctaatgcttggcagccacggctcataccacttgcataacaataaacaaaaaatagttagtctacactaaaatccaaggtggctgctgaacgtcgtagcttccgaatgtccggaatctgctgctcaggttcctataaaaatccttccctccctgcatctcagcatccctgttcaccatcccacttcaacagttcaaccgccaggtcacacgcttgccagcactgatcgtcatggagaacaaggcgggaacagaggaagccctgctcctgtcgcgccccgagaacacggtcgcggcggaggccaagcggctgctgcggctggcggggcccctggtggccagctgcatcctgcagaacgtcgtccagctggtgtccgtcatgttcgtcggccacctcggcgagcttcccctcgccggggcctccctggccagctccctcgccaacgtcaccggcttcagcctgctcgccggcatggcgagcgcgctggacactctgtgcgggcaggccttcggggcgcggcagtacggcctcctcggcgtgtacaagcagcgcgccatgctggtgctcgcgctcgcctgcgtcccgatcgccgtcgtctgggccaacgccggccagatcctcgccctcatcggccaggatcacgacatttcggcggaggccggggcttactcccggtggctgatactgtgcctggttccctacgtcccgctcgtgtgccacgtccggttcctgcagacgcagagcatcgtcgtgccagtgatggtcagctccggcgtcacggcgctgagccatgtcttcgtgtgctgggcgctggtgttcaaggccggcatggggagcaaaggcgccgcactgagcaacgccatcgcctactgcgtcaacctggccatgctagctctctatgtgaggctgtcaggcgcgtgcacgaggacatggactggattctccaccgaggctttcaaagagctgcgccggttcactgatctcgccgtcccttcagcgatgatggtctgcttggagtggtggtcatttgaactgcttgtgttgctctctggtcttctgcccaatcctaagcttgaaacctcggtactgtcgatatgtctcaacacgggtgctctgatgttcatgataccctttggtctctgtacagccataagcacacgagtttcgaatgaactcggcgcgggtaagccccaagcagcgaagctggcaactcgagtggtcatgtgtatcgccttgtctgcaggtttgctgctagcctctaccatgattttgctacgcaatctatggggctatatgtacagcaacgaacctgaagttgacacatacattgcgaaaatgataccggttctcgccatatcattcttcacggatgggcttcacagttccttatctggagtactgactggatgtggtgagcagaagatcggcgcacgtgttaatctcggtgcgttctacttggccggcattcccatggccgtgttgcttgcatttgtcctccatcttaacggaatgggtctttggcttggcattgtctgtggcagcctcaccaagcttgtgttgctcacgtggatcacactgcggataaactgggacagtgaggcaatcaaggcaaaagaaacggtgttcagttcttctcttcccatagcatgacagcgttatatgcaaacaggacggataaaaccataatggcgtcattgcacagacattggggacacattttctctaagttagcaagtagtaatcataagttattattcaataccccaacgggatatttttgttagtgcctctatttatcggagaggtttgattcgctgtaacttctccaaaacaagcaaaatttaatatctttatttatttgaatatatccagtgtttcacgttgaa

SEQ ID NO: 345 - DNA, 2298 bp, Panicum virgatum
tacactaaaatccaaggtgggtgccgaacgtcgtagcttccgaatgtgtggtatctgctgcttagattcctataaaaatcgtttactcccagcatctgcgcactactgccactctgttcacgattccacttcaaaaccttgaggccacacgctttgtaaactctgatcatcatggagaacaaggcagaaacagaggagccccttctcctggcgcggcccgagaacacggccgcggcggaggccaagcggctgctgcggctggcggggcccctggtggccagctgcatcatgcagaatgccgtccagctggtgtccgtcatgttcgtcggccacctcggtgagctgcccctcgccggcgcctccctggccagctccctcgccaacgtcaccggcttcagcctgctctgcggcatggtgagcgcgctggacacgctgtgcgggcaggccttcggggcgaggcagtacggcctcctcggcgtgtacaagcaacgcgccatgctggtgctcgggctcgcctgcgtcccgatcgccgtcgtctgggccaacgccggccggatccttatcctcctcggccaggatcacgacatcgccgaggaagctggcgcctactcgcggtggctcataccgtgcctcgtccctttggtcccgctcgtgtgccacatccggttcctgcagacgcagagcatcgttgtgccagtgatggccagctccggcgtcacgtcgctgagccacgtcttcgtgtgctgggcgctggtgttcaaggccggcttggggagcaaaggcgctgcgctgagcaatgccatctcctactgcgtcaacctggccatgctcgctctctacgtcaggctgtcaggcgcgtgcaagaggacatggacaggattctccaccgaggctttcaatgagctgcgccggttcactgagctcgccatcccatcggcgatgatggtctgcttggagtggtggtcatttgaactactcgtgttgctctctggccttctgcccaatcctaagcttgaaacctcagtattgtcgatatgtctcaacactggttcgttgctgttcatgataccatttggtctctctacagccataagcacacgagtttcgaatgaacttggcgctggtcagccccacgcagcgaagctggcaactcgagtagtaatgtgcatcgccatgtctgccggcttggttctagcctctaccatgattctgctacgcaatgtctggggctatatgtacagcaatgaacctgaagttatcacatacattgcaaaaatgatacctgttctcgcgatatcgttcttcacagatgggcttcacagttctctatccggagtactgactggatgcggtgagcagaaggtcggcgctcgtgttaatctcggtgcgttctacttggccggcgttcccatggccgttttccttgcatttgttctccatcttaacggaatgggtctttggcttggtattgtctgtggcagcctcaccaagcttgtgttgctcatgtggatcacactgcggataaactgggagaaagaggcaacgaaggcaaaagaaacggtattcagttcatctctacccatagcatgatggtgttatgtgtaactggacaaataacagtgcaatggcgccatcgcagctgcagacaaatcatcccactgcgcacaaggaaattgacagacatttgagatatattttctctaagttaattagcaaataatcattttatgctttattaaatttgaaagtttgcagggttttcctttttctgcgcacttcaacacagtttatgaaaactatttttaagcatccaaactggatttatgtgcaaaagtatttatagaagtgactctttctccctgacgtcatacatactagtgatgtaaactacttgcccattaaattggcgtttcataacaaaaattggacactactagtagctgcgctctgttcggctagctgtggctgatagctggtgctgatttgttgtaagagaaaattactgctggctggctgctagctgatggctgatgctgatttggtgtgaaagaaaaatactgctggctagctggctgacaagccagctaacattgccatttcgatttaatcaagctagtcttatttcctgaagatattacaaccttacaaaatttgccactcccaagtcaaacatatatttttcatagctacagatattttgtgcacctataaacatatatagaggcagacagctcactcttatcacttgttgctagcaagtgaatccaaacatcagaagatctagttctgctattctgg

SEQ ID NO: 346 - DNA, 1572 bp, Sorghum bicolor
ttcggatcacaagcttgtgaaccctgatcatcatggacaacaaggcagctacggaggagcccctgctcgtgccgcggcccgagcacacggccacgtcggaggccaagcggctgctgagcctggcggggccgctggtggccagctgcatcctgcagaacgtggtccagctcgtgtccgtcatgttcgtcggccacctcggcgagctgcccctcgccggtgcctccctggccagctcgctcgccaacgtcaccggcttcagcctgctcgccggcatggcgagcgcgctggacacgctgtgcgggcaggccttcggggcgaggcagtacggcctccttggtgtctacaagcagcgcgccatgctggtgctcgcgctcgcctgcctcccgatcgccgtcgtctgggccaacgccggccggatcctcgtgctcctcggccaggaccgcgacatcgccgcggaggccggcgcctactcccggtggctcatactgggcctcgtcccctacgtcccgctcgcgtgccacatccggttcctgcagacgcagagcgtcgtcgtgccggtcatggtcagctccggcgtcaccgcgctgggccacgccgtggtgtgctgggcgctggtgttcaaggccggcatgggcagcaaaggcgccgcgctgagcattgccatttcctactccttcaacctggccatgctagctctctacgtgaggttctccagcgcgtgcaagaggacatggactggattctccacggaggctttcaaagatctacaccggttcactgaactcgccatcccatcggcgatgatggtctgcttggagtggtggtcctttgaactgcttgtgcttctctctggtctgctgcccaatcctaagcttgaaacctcagtactgtcaatatgtctaaacactggtgctttgctgttcatggtaccatttggtctttgtacagccataagcacacgtgtttcaaatgaacttggtgccggtgagccacaagcagcgaagctagcaactcgagtggtcatgtgtatcgccttcaacgaacctgaagttgtcacatacattgctagaatgataccagttcttgcgatatcgttcttcacagatgggctccatagttgtctatcaggagtggtgactgggtgtggtgagcagaagatcggtgcacgcgttaatctcagtgcgtactacttggccggcattcccatggccgtgttccttgcatttgtcctccatctgaatggaatgggtctgtggcttggcattgtttgtggcagcctcaccaagcttgtgctgctgttgtggatcacactgcggataaactgggagaaagaggcaatcaaggcaaaagaaacagtgttcagttcaactcttcccatagcatgatagagttatgtgcaactggacataacaccaccacgacttctgctacactaccttcccaattgagagacattagggttcttatatgttctctaacgtaacatgttagctagtaaaaagatcctgttattaaatatccttatcatcagggatatgatatgattgtgtctctattcatcatagaggttcc

SEQ ID NO: 347 - DNA, 1857 bp, Panicum virgatum
tctctgcactctgttcccgattccacttgaaaaccttcatccaggcaatcaggccacacgctttgacaactctgattacttatcatggagaacaagaagccaggaagagtagaggagccccttctcgtggcggcgcggcccgagaacgcggccgcggcggaggccaagcggctgctgcggctggcggggcccctggtggccagctgcatcctgcagagcgccgtccagctggtgtccgtcatgttcgtcggccacctcggcgagctgcccctcgccggcgcctccctggccagctccctcgccaacgtcaccggcttcagcctgctgttcggcatggcgagcgcgctggacacgctgtgcgggcaggctttcggggcggggcggcacggcacggcctcctcggcgtgcacaagcagcgcgccacggtggtgctcgcgctcgcctgcgtcccggtcgccgccgtctgggccaacgccggacggatcctcgtcctcgccggccaggaccgggacatcgccgaggaggccggcgcctacgcgcggtggctcatcccgtgcctcgtcccctacgtcccgctcgtgtgccacatccggttcctgcaggcgcagagcctcgtcgtgccggtgatggccagctccggcgccgccgcgctgggccacgtcgcggtgtgctgggcgctggtgttcaaggccggcatggggagcagaggcgccgcgctgagcaacgccatctcctacggcgtcaacctggccctgctcactctctacgtcaggctgtcgggcgcgtgcgcgaggacatggacgggattctccaccgaggctttcaaagagctgcgccggttcactcagctcgccatcccatcggcgatgatggtctgcttggagtggtggtcatttgaactactcgtgttgctctctggcctcctgcccaatcctacgcttgaaacttcagtattgtcgatatgtctcaacactggctcgttgctgtttatgataccatttggtctctctacagccataagcacacgagtttcgaatgaacttggcgccgatcagccccaggcagcgaagctggcaactcgagtggtgatgtgtattgccatgtctgccggcttggttctagcctctaccatgattctgctacgcaatttctggggctatctgtacagcaatgaacctgaagtcatcacatacattgcaaaaatgatacctgttctcgcgatatcattcttcacggatgggcttcacagttctctatccggagtactgactggatgcggtgagcagaaggtcggcgctcgtgttaatctcggtgcattctacttggccggcgttcccatggccgttttgcttgcatttgttctccatcttaacggaatgggtctttggcttggtattgtctgtggcagcctcaccaagcttgtgttgctcatgtggatcacactgcggataaactgggagaaagaggcaatgaaggcaaaagaaacggtattcagttcatctcttcccatagcatgatggtgttatgtgtaactggaaaagtaacactgcaacagctgcacacaatcataccactgcgctcaaggaaattgacagacatttgggattattttgtctaagttagcatataatcatttttcttcaatatcctccccaccaggatatgatttgtactgcctttgtttatcaaagagctttcattcattacactataacctataaatagatattaaatttgatgcctttatttatttgaaagctcgcagggttttcctttttctgcgcatttcaacacggtttatgtaaactattttgaagcatcaaaactggatttatgtgcaaaaaatattcctattta

SEQ ID NO: 348 - DNA, 1902 bp, Aegilops tauschii
tgcgtccagcctcagctgaagctgacaagaatggagaagccgagcgtagacgagcagcccctgctcgtggagcgggacgagaatgccgcggcaccggaggcgaagcgactgctgcggctggctggaccgctggtggcaagcggcatcctccagtgcgcgctgcagctggtgtccgtgatgtttgtcggccacctcggcgagctgccgctcgccggcgcctcgctggccacctccctcgccaacgtcaccggcttcagcctgctggtcggcatggcaagcgcgctggacaccctgtgcgggcaggcgttcggcgcgcggcagtaccacctcctcggcgtctacaagcagcgggcgatgctggtgctcacgctcgcctgcgtccccatcgccctcgtctgggccaacaccgcccggatcctcctgctcctcggccaggacacggccatcgccgcggaggccggtgcctacgcgcggtggctcatcccggccctcgtcccctacgtccctctcacgtgccacatccggttcctgcagacgcagagcatggtcgtgccggtgatggccagctccgccgtcacgtcgctgagccacgtcctcgtgtgctgggcgctggtgcacagggctggcatgggcagcaaaggcgcggcgctggccacagcagtatcatactccgcaaacctggccatactgtccctgtacacaaggctgtccggcgtatgcaagacgacatggactgggttctccatggaggccttcaaggagctgcgccagttcgcggagctcgccgtcccctcggccatgatggtttgcttggaatggtggtcgtttgaattgcttatgctgctctctggccttctgcctaatcctaagctggaaacctcagtattgtcaatatgtcttaacactggtgctctcatgttcatggtgccatctggtctctgcacagccataagtacacgtgtttccaatgaacttggcgccggtaggcctcaggcagcgaagctagcaactagactggtcgtatgcatggccctgtttgccggctcagtgatctccatcacaatgatttctctacgcaaattttggggctacatgtacagcaacgaggaagaagtcgtgacatacattgccaggatgatacctgtcctcgccatatctttcttcatagatggaatccacacatctctttcaggtgtgctctatggatgtggtgagcagaagattggtgcgcgtgtcaacctcgccgcgttctacttggcaggcatccccttggccgtgttgcttgcatttgtcttgcatttgaacgggatgggtctttggctcggcatcgtctgtggcagtctcaccaagcttgtgttgctcatgtggatcgttctttcgataaactgggagaaggaggcaatgaaggcaaaagacatggtgttaggatcttctcttccggctgcatgaagataatacctacggcggcaacacgcattttgtgatttgaagaaacgtgcaagcgaatggaaacaaatcgatatacgtagctatgccattttgctttcagaaggaaggagaaaatgtggatattgaggactaagattataattacaaacaacatcagaggtaacaaaaattacaactagatccgtagaccacttagctgcgactacaagcattggggcgagccgaaggcgcgccaccatcatggctaatttttttaaaataatacttttttattaattttcataaatattacgctggacacaacattttcaaaaataatgcaccatcggcctgctgctggccgattgggcctagtcagcccacagcaggccgactggcatcctatcagcttgctgctgaccgaatggcctatcagccactagtgcagatcctgtcggtcacctgttggccgac

SEQ ID NO: 349 - DNA, 1609 bp, Triticum aestivum
tcctaactacttctgctcctgcgtccagcctcagctgaagctgacaagaatggagaagccgagcgtagacgagcagcccctgctcgtggagcgggacgagaatgccgcggcaccggaggcgaagcgactgctgcggctggctggaccgctggtggcaagcggcatcctccagtgcgcgctgcagctggtgtccgtgatgtttgtcggccacctcggcgagctgcccctcgccggcgccgcgctggccacctccctcgccaacgtcaccggcttcagcctgctggtcggcatggcaagcgcgctggacaccctgtgcgggcaggcgttcggcgcgcggcagtaccacctcctcggcgtctacaagcagcgggcgatgctggtgctcacgctcgcctgcgtccccatcgccctcgtctgggccaacaccgcccggatcctcctgctcctcggccaggacacggccatcgccgcggaggccggtgcctacgcgcggtggctcatcccggccctcgtcccctacgtccctctcacgtgccacatccggttcctgcagacgcagagcatggtcgtgccggtgatggccagctccgccgtcacgtcgctgagccacgtcctcgtgtgctgggcgctggtgcacagggctggcatgggcagcaaaggcgcggcgctggccacagcagtatcatactccgcaaacctggccatactgtccctgtacacaaggctgtccggcgtatgcaagacgacatggactgggttctccatggaggccttcaaggagctgcgccagttcgcggagctcgccgtcccctcggccatgatggtttgcttggaatggtggtcgtttgaattgcttgtgctgctctctggccttctgcctaatcctaagctggaaacctcagtattgtcaatatgtcttaacactggtgctctcatgttcatggtgccatctggtctctgcacagccataagtacacgtgtttccaatgaacttggcgccggtaggcctcaggcagcgaagctagcaactagactggtcgtatgcatggccctgtttgccggctcagtgatctccatcacaatgatttctctacgcaaattttggggctacatgtacagcaacgaggaagaagtcgtgacatacattgccaggatgatacctgtcctcgccatatctttcttcatagatggaatccacacatctctttcaggtgtgctctatggatgtggtgagcagaagattggtgcgcgtgtcaacctcgccgcgttctacttggcaggcatccccttggccgtgttgcttgcatttgtcttgcatttgaacgggatgggtctttggctcggcatcgtctgtggcagtctcaccaagcttgtgttgctcatgtggatcgttctttcgataaactgggagaaggaggcaattaaagcaaaagacatggtgttaggatcttctcttccggctgcatgaagataataccctatggcgggaacacgcattttgtgatgcgaagaaacatgcaagcgaatggaaacaaatcgatatacatagctatgccattttgctttgagaagcatggagaaaatgtagatattggggactaattttata

SEQ ID NO: 350 - DNA, 2834 bp, Sorghum bicolor
acctgcgttgaaccttcatttgatggaaacataccatgatttgattggtggaggttatgtgcgctgaagtcatcatgttggtgtggctgttgttccttggtttgttgatctggttcctgctccttttgcagcaagtttactttgatatctgccgccacgacattatgaaccttttgtcattcctggctttccagatgtaccacaaagtggtgactagaacctgcatctgttcatctgatgtttgctgatcgatcaatattggaagtatttcctgtacttcatcttactcaagatggtagcatggaagaacacaggaggatttgcagaacaaatgagcatcatttcagtggtgttacaagtagaatagtacttacttattttagttgagtacttcctgctctttcaccagctgctattgctcgtctgatcagcctccaaagaaaggtcttgatacagggtggcaaggtcttgtgtttccatgctctcttgaggaatgtacatagcctgagatggaaatgcttctggatccctgcattggtaattgtacctgggagtttgagtttaaaagctcattagcagtgcatataccttttgccactggtttccatcttatgatgtcagtctcattggaggaacagtttgaagctgagtgatttcttgggtggcctcatggctgaagatgcttgagatgaggggagtgttccaaatctgagtgttcaggatccagagttcagccacatttagaggaagagagggctgagtgacaggaagattaagatgagagtgaatggattcccagaggttgcaccatggggtcgaccagatgctggagttgccttggtggatttggataatgcaatgttggtgaagggtatccttgagctgcaggagaggcccggaagatggatttgggtctgttgtttttggctgtccagaaggagttgtcagggaaatatttggacaattgcagtgagataagggtctttggcagtaacaatgttccaggcagcttgtaggataaggcttatatttacaatccaagcccccattatctaaattcaggagcactgtaagctcaataccatgcactgtgcagtgtactggagcagctgagtgttctcttatcaattgccacacatacgagtgaagagatgatggatgaatgatttgccatcttcattggattaatggattgtgaggaaacttggtatttctgcaacataagaggcattgacagatgttttaaagcatggtattcatggcgattttggtgatcggcaatgttcttgaggggctttgcgctcacaagtacgcctagctgaaaacaacttctgtcagccggtgaaatgccattcgatgcacttgcctaactggctctgcattctggcattcagaggtgttgtttgtatagaacttgttatcctaacttatctgattctgttagtgtttgattattaatttatgacaaggcataattttcaaccatcttcagatgacgcttgaatttagaaactagctcatactgcagaagctgtttatactttatacttgagaagcaagaaaccgtgagtgtgacaaccagaatgagatctaaatctgacgcaatagccagaagaactcaggttggacagtgtggtccgttccattgggggttccctggggacctagaccagatggccgggctgttcaccgagcaggctgctgtgtacgccgcagcacgcccggcgtacccgaaggatctgtttgccaagctctcggcgctcaccgctcaccaccgccgcgcttgggacgtcggtactggcaatggccaggccgccatcggtgttgctgagcactacgacagcgtggtggccacggacgcgtccgtggagcagctgcggcacgccacgccacaccccagggtccggtacctgcacacctccgacgccttgccggaggacgacctcgtcgccatgctgggcggcgaggccagcgtggacctcatcacggtggctctggccgtgcactggttcgacctcccggcgttctatggcgtggcgtgccgcgtcctgcggcggcccggcggggtgatcgcggtctggggatacaactaccgcatgagccctgtggaggacatgatggcgcgcttcttcgacaccacgctgccctactgggacccccgagctcggtactgcactgacggataccgggacctgccgttccccttcgaggacatcgggctcgggaaggaaggagagccggcgagcctcgacatggagcaggagatgtcgttcgagggcctgatcggcgtgctgaggtcgtggtcggcggtgacaacggccaagcagcagcagggcgtggacctgttgggggagcgcgttgtgaaggagctggaggaagggtggggaggggcatcgctggtgaggaaggtcacctacaagggcttcctgctggcaggcaccccggggcccacggctgatgagtgatgttgttcttagagcaagtttaataatacagaccacttgctggtcgtaaggtttttttgcagccttctcttagctcactcatacaatagttagctatttactattaatacatgacctatttatctttcttaaaaagtttctcctttctctcctcccttctcttctccatctcttctcttctccatctcagtatttagctggcttacaggccactataatacttgctcttagggcagtcctaatgctagaaattacatgtaatttttatacctactaatttacactacatatagaaattatggtctcaatagattgtttcagtagaataattttcttatccaattacattcatcctctctctccattctc

SEQ ID NO: 351 - DNA, 910 bp, Panicum virgatum
tcaggttggacagtgtggggtttccctggggaccttgaccagatggccgagctattcaccgagcagtccgctgtgtacgccgcagcacgcccggcgtacccgaaggatctgtttaccaagctctcggcgctcactgctcaccaccgccgcgcttgggacgtcggtactggcaatggccatcggtgtcgcggagcactacgacagcgtggtggccacggacgcgtccgcggagcagctgcggcacgccgcgccacaccccaaggtccggtacctgcacacccccgacgccacgccgggggaggaggacctcgtcgccatgctgggcggcgaggccatcgtggacctcatcacggtggcgcaggccgtgcactggtttgacctcccggcgttctacggcgtggcgcgccgcgtcctgcggaggcccggcggggtgatcgcggtctggggctacaactaccgcatgagccccgtggaggacatgatgtcgcgcttcttcgacaccacgcttcccagtagagacccccgagctcggtatttgactgacggataccgggacctgccgtttcccttcgaggacgtcgggcttgggaaggaattaggagagccggcgagcctcgacatggagcaggagatgtcgttcgagggtctgatcgacatgctgaggtcctcatcggcggtgacaacggcgaagcagcagggcgtggacctgctgggggagcgcgttgtgaaggagctggaggaagggtggggagggccgtcgctggtgcggaaggtcacctacaaggccttcctgctggcaggtaccccggggccgaaggctgatgagtgatgatgtcgctcatcttcctgcgattgaactaggagtaataatcatctgtgtttcgcgaataacatggcattaaatttttgc

SEQ ID NO: 352 - DNA, 2227 bp, Setaria italica
ctgggcactctttagtctgtgcatgacattccttctgtacgtttcagcaattttcttgcgagtattgttcaaacattggtgactgctgaccagtatttagctgcttccataagccattgaacttttgcgcaattggtattcaatttgactgctgcaaattcaggggcattataagctcacaccattcactttgtggtgacatcctggggaccaagtgttatcttaccaaccgcaacacatggatgaaaagttgataagggaatggtcattggaatgatcttatctccattagggtggagagcaaatggtcttgccatgattgctactgtaatggtgagggaacttggtttctgaagacatggtgagaacatgtctggggcagtggcagaccattctggaggatgctggtggctgttcatggctttcttggtgaatctcgcagtatctagctatatcgtaactgctgcaaattcaggggcaatgcttaccccatacactgtgcagtatcatcctttggacttattatcttaccaattgctacacatggatgaaaaaaaaatgcaggaatgatctgtcatcttcataggattatgatgaagcttgatttctgtaggcattacgagaacatgtatgcagcattagaagcatttgcagatgcttctggaggatggtagaggcattatgctcaaaggtttgccctcccatgtaaacagcttgtcagtcagctaatgccacccagtgtgcttacctaacttcagtaccttcaccagctctggtaccccatttcagatctaaaagatctgcacatgcaacagccagatgaactgaggttagacagaggtctgttccactggggaccggactggatggctgggctgttctccaagcaggctgctgtgtatgctgcagcgcggccagcctacccgaatgatctttttaccaagcttgcggcactcacagctcaccactgccttgcctgggatgtcggcaccggcaatggccaagcagccatcggtgtcgccgagcactacgacagtgtgctggccacggatgtgagcgaggaccagctcctacatgctgcaccacacccgaaggtccggtacctccacaccccagatgccacaccaggggaggacctcgtcgcgacgctcggtggtgagggcagtgttgacctcatcacggtggctgaggctgcgcactggttcgacctcccggcgttctatgacgtcgcccaccgagtcctgcggaggcccggcggggtgatcgccgtctggggctacaactaccgcatcagccccgtggaggacatgatgacgcgcttcttcaacaccacccttccttactgggacccccgagctcggtgttgcactgatggataccgggacctgccgttccccttcgtcgacatcggcctcggtagggaaggtgagccggcaagcctcgacatggagcaggagatgtcgttcgagggcctgataggcatgctgagttcgtggtcggcggtgacgacggcgaagcagcagggcgtggacctgttgggggagcgcgtggtgaagcagctggaggaagagtggggaggggcgtcgctggtgcgcaaggtgaccttcaaggccttcctgctggcaggtacccccagggccgatgattgatatgagtgatgttgctcttcctgggtcctgggattggattgggagttactctatttgtatttcgtgaataacgtagcatctgttctacttctgttttgcgttgcagtttatgatccattctccttgagtccttgttgaagctctacttctttaatgacaatttcggtgctccattccacatactcagatgaaaaagaaaaccccctcaactgaatactagaaaggaaaaaaaaatactgaacctctgttattgaagtatttatccaaagagaatgctttaatcatggtatatgtgaactttcaagctatcacaaaagagcaaaaaacaacagagctccaacacgacctacaaaaatgggcacggcgtactgccatgccaaagctccctcacctgtgccatctctcacccgaggcgccaaggtgagccacaatgagaggcgcatggaagataagatgtaagatttctcttttttttttggttttattttctattttctgcgagggataaggagctggaacgttttactggcgcgtagtatgacagtgtggcaacaaaggttggctatgattcaatggaa

SEQ ID NO: 353 - DNA, 1221 bp, Pennisetum glaucum
ttggtttgtgcagacattacgagaacgtgtatgcagcattagtagcatttccagatgcttttggtggagggtagaggaggcattgtgctcaaaggcccaccctcccatgtagacagcttgtcactcagctaatgccacccaatgtgcttacctaattatctagaagatctgcacacgcaacaaccagaagaactgcggttggaccggggacctgaccaaatggctgggctgttctccaagcaggctgttgtgtatgccgcagcacggcctgcctacccgaaggatgtttttaccaagcttgcagcactcaccgctcagcaccgccttgcctgggatgtcggcactggcaatggacaggcagccatcgatgtcgctgagcactatgacagcgtgctggccacggatgtgagcgaggaacagctcctacatgccgcaccgcacccgaaggtccggtacctccacacccctgatgccacaccaggggaggacctcatcgcgatgctcggtggtgagggcagtgttgatctcatcacagtggctcaggctgcgcactggttcgacctcccagcgttctatggtgtctcccgccaagtcctgcggaggcccggcggggtgatcgccgtatggggctacaactaccgcatgagccccgtggaggacatgatgacgtgcttcttcaacaccaccctgccttactgggacccccgagctcggtgctgcattgatggataccgggacctgccgttccccttcgtcgacatcggcctcggtagggaaggcgagccggtgagcctcgacatggagcacgagatgtcgttcgaaggcctgataggcatgctgcgttcgtggtctgcagtgaccacggcaaagcggcagggcgtggacctgttgggggagcgcgtggtgaagcagctggaggaagagtggggtggcgcgtcactcgtgcgcaaggtgaccttcaaggccttcctgctggcaggtacccccagggccgatgagattgatgagtgatgttgctcttgctgggtcctgggagattggattgcgagttgctgtgcttgtatttcgtgaataacgtagcatttgttctgcttatgaaaaacgtgacccattattatcctcgagtccttgttatgtatctgaatgtatctatacatgtcaaaacgactagtaatttgagacggagggtgtatttatctaaaaaaaattgctttaaccaag

SEQ ID NO: 354 - DNA, 1926 bp, Sorghum bicolor
aacccagcacagcagccgaacacagcagagcagagcaacatattgttttgatcaacacaccgactaattaagcggtcagcagcagagctcagcatggcggtgtccgcggccagggtggccgtcgccacggccgtctccttagccgtgcactggctcctccggtccttcctccaggcgcagcaccccgcgctgggcctgctcctcctggccgccgtcttcctcggcattgccgcgacgggcaacgctggcgccgccaacgcgccgccggggccggcggccgtgccggtgttcggcaactggctgcaggtgggcaacgacctgaaccaccgcttcctggcgcgcctgtcggcgcggtacgggcccgtcttccgcctccgcctcggcgtgcgcaacctggtggtcgtctccgacccgcggctcgccacggaggtgctgcacacgcagggggtggagttcggctcccgcccccgcaacgtcgtcttcgacatcttcaccgccaacggcgccgacatggtcttcaccgagtacggcgaccactggcgccgcatgcgccgcgtgatgacgctgcccttcttcaccgcgcgcgtggtgcagcagtacagggacatgtgggaggccgagatggacgccgtcgtctccgacatctccggggacggcgcggcccagcaagccggcttcgtcgtgcgccgcaggctgcagctcatgctgtacaacatcatgtaccggatgatgttcgacgcgcgcttcgactcggtcgacgaccccatgttcgtggaggccaccaggttcaactccgagcgcagccgcctcgcgcagagcttcgactacaactacggcgacttcatccccatcctgcgccccttcctgcgcggctacctcaacaagtgcaaggacctgcagaccaggaggctcgccttcttcaacaacaactacgtcgagaagaggagaaaggtgatggacacgccgggggacaagaacaagctcaggtgcgccatcgaccacatcctccaggcggagaagagcggcgagatcacctcggagaacgtcatctacatcgtcgagaacatcaacgtcgcggccatcgagaccacgctctggtccatcgagtgggcgctcgcagaggtcgtcaaccacccggcggtgcagcgcaaggtccgcgacgagatcaaggccgtcgtcggcgacgacgagcccatcacggagtccaccatccacagactcccttacctgcaggctgtcatcaaggagacgctgcgcctccactcgcccatcccgctcctcgtcccgcacatgaacctcgaggaggccaagctcggcggctacaccatccccaagggctccaaggtggtggtcaacgcgtggtggctggccaacaacccggagctgtgggagaagcccgaggagttccggccggagcggttcctaggcgaggagaagagcgtggacgctaccgtcggcgggaaggtggacttcaggttcctgccgttcggcgtgggccgccgcagctgccccgggatcatcctggcgctgcccatcctcgcgctcatcgtcgggaagctcgtgcgcagcttcgagatggtaccaccgcccggcgtggagaagctcgacgtcagcgagaaaggaggacagttcagcctgcacattgccaagcactctgtcatcgccttccaccctgtctctgcatgacgatgatagccaaaccacgaatgcggcgcgtcattttgacattttctgcagatgaatgttaccctacccactcatttttcgcttttattagttggcacttttcacgtatacgattttagtacaggagaaatgtcgagtcagggttcaaaaataatttattgttcagagttttttgtgtgattataaaactgaaatattactgtcaccagttatctaatttaattgatatagttcagactc

SEQ ID NO: 355 - DNA, 1998 bp, Panicum virgatum
cggcgcccccacgcttccgcgcacctcccctcggcaaccaacccagtttccgtgctccgcgcacacgggtttccgctcaaaaccaaggaatccccccgctccgtttttaccacggccaccaaccaaccgatagctgggcacggcgtcatataaaacccagcaccagcagccaaacaagcacagccgccagcgccagcacagcaactctcaggcacacagctagtgatcagcagcgcaccgcggcagcaatggtggtatccgcggccagggtggccgtcgccacggccgcctccttggccgcgcactggctcgtccactccttcctccagccctgccaccaccccgcgctgggcctgctcctgccggccgccgtcttcctcaccatcgccgtgctgggcggcggcagcgcgccgccgggcccggcggccgtgccggtgttcggcaactggctgcaggtggggaacgacctcaaccaccgcttcctggcgcgcctgtccgcgcgctacgggcccgtgttccgcctccgcctcggcgtgcgcaacctcgtcgtcgtctccgacccgcggctcgccgcggaggtgctccacacgcagggggtggagttcggctcccgcccccgcaacgtcgtcttcgacatcttcacggccaacggcgccgacatggtcttcaccgagtacggcgaccactggcgccgcatgcgccgcgtcatgacgctgcccttcttcacggcgcgcgtcgtgcagcagtaccggggcatgtgggaggccgagatggacgctgccgtcgccgacatctccggcgacggcgcggcccagcgcggcggcttcatcgtgcggcgcaggctgcagctcatgctctacaacatcatgtaccggatgatgttcgacgcgcgcttcgactccgtcgacgaccccatgttcgtcgaggccacccggttcaactccgagcgcagccgcctcgcgcagagcttcgagtacaactacggcgacttcatccccatcctgcgccccttcctgcgaggctacctcgacaggtgccgggacctgcaggccaggaggctcgccttcttcaacaacaactacgtcgagaagaggaggaaggtcatggacacgccgggggacaagggcaagctccggtgcgccatcgaccacatcctccaggccgagaagagcggcgagatcacgccggagaacgtcatctacatcgtcgagaacatcaacgttgccgccatcgagaccacgctctggtccatcgagtgggcgctcgccgaggtcgtcaaccacccggcggtgcagcgcaaggtccgcgacgagatcagggacgtgatcggggacgacgagcccatcaccgagtccaacatccacaggctcccctacctgcaagccgtgatcaaggagacgctgcgcctccactcccccatcccgctcctcgtcccgcacatgaacctcgaggaggccaagctcggcgggtacaccatccccaagggctccaaggtggtggtgaacgcctggtggctcgccaacaacccggagctgtgggagaagccggaggagttccggccggagcggttcttgggcgaggagaaggccgtggacgccaccgtcggcgggaaggtggacttcaggttcctgcccttcggcgtgggccgccgcagctgccccgggatcatcctggccctgcccatcctcgcgctcatcgtcggcaagctcgtgcgcagcttcgagatggtgccgccgcccggcgtcgagaagctcgacgtcagcgagaaaggcgggcagttcagcctacacattgccaagcactccgtcatcgccttccacccaatctctgcatgaactagagcgctgcagatcatttctgcacatggaataagttaccctgcacaataacttttcgtttttatttaattggtatagagttacggcagaaatgtggaagaaaattattttacagaagagttaaatataccagcggtcctcgaacttgttccgaggtgtc

SEQ ID NO: 356 - DNA, 1890 bp, Setaria italica
aagcagagccgccagtacagcagagcatccccaaccaacaacacactcacatcgcgttgcacagcaagtgatagcagtagcagctgcagcgcacagcgacagcaatggcggtgttcgcggccaggttcgccgtcgccacggtcgcctcctttgccgtgcactggctcgtccactccttcctccagtaccagcaccccgctctcgtcctgctcctgccggtcgccgtcttcgtcggcatcgtcgcgacgggtagcgacagcagcggcgccgggagcgcgcctccgggcccggcggccgtgccggtgttcggcaactggctgcaggtgggcaacgacctgaaccaccgcttcctggcgcgcctgtccgcgcggtacggtcccgtgttccgcctccgcctcggcgtgcgcaacctcgtcgtcgtctccgacccgcggctcgccacggaggtgctccacacgcagggggtggagttcggctcccgcccccgcaacgtcgtcttcgacatcttcaccgccaacggcgccgacatggtcttcaccgagtacggcgaccactggcgccgcatgcgccgcgtcatgacgctgcccttcttcacggcgcgcgtcgtgcagcagtacaggggtatgtgggaggccgagatggacgccgtcgtcgccgacatctccgccgatcgggccgtggcccagaccgccggattcgtcgtgcgccgcaggctccagctcatgctctacaacatcatgtaccggatgatgttcgacgcgcgcttcgactccgtcgacgaccccatgttcgtcgaggccaccaagttcaactccgagcgcagccgcctcgcgcagagcttcgagtacaactacggcgacttcatccccatcttgcgccccttcctacgcggctacctcaacaaatgcagggacctgcagaccaggaggctcgccttcttcaacaacaactacgtcgagaagaggaggaaggtcatggacacacccggggacaaggacaagctccggtgcgccatcgaccacatcctccaggcggagaagaacggcgagatcacgcccgacaacgtcatctacatcgtcgagaacatcaacgtcgccgccatcgagaccacgctctggtccatcgagtgggcgctcgccgaggtcgtcaaccacccggacgtgcagcgcagggtccgcgacgagatcaggggcgtgatcgccgacgacgagcccatcaccgagtccaacatccacaagctcccctacctgcaggccgtgatcaaggagacgctgcgcctccactccccgatcccgctcctcgtcccgcacatgaacctcgaggaggccaagctcggcggctacaccatccccaagggatccaaggtggtggtgaacgcctggtggctggccaacaacccggagctgtgggagaagcccgaggagttccggccggagcggttcctgggcgaggagaaggccgtggacgccaccgtcggcgggaaggtggacttcaggttcctaccgttcggtgtgggccgccgcagctgccccgggatcatcctggccctgcccatcctagcgctcatcgtcggcaagctcgtgcgcagcttcgagatggtgccgcccggcgtggagaagctcgacgtcagcgagaaaggcgggcagttcagcctgcacattgccaaccactctgtcatcgctttccacccaatctctgcatgaactacgagcgctagctgcgggtcatgtctgcagatgaaacttagcctgcacgataactttcggttttgattggtatacgggttacagaatttattttgagtctttctcggatatgtaatttggaaattgaaatgttaatgtcatcattcatactaatttgagactgagttctgctctatttcccgcc

SEQ ID NO: 357 - DNA, 1894 bp, Hordeum vulgare
agcaaccaacaacatagttactcgtatcagcaacgccaagctagcacccgcgcagagcacagcatgactgcctccgcctccgcgcgtaggatggccttcgccgcggcggcctccctggccgtgtactggctcctcaagtcgttcctccacacacctcaccccgcgctgctgccggcggcggcggccctcgtggccctcaccatcactctgggagcttcggggaagggtggcggcgccggcgctcctcccgggcccgcggccgtgccggtgttcggcaactggctgcaggtgggcaacgacctcaaccaccgcttcctggcagggctttcggcgcggtacggccccgtgttccgcctgcggctgggcgtgcgcaacctggtggtggtgtcggacccgcggctggccacggaggtgctccacacgcagggcgtggagttcgggtcccgcccgcggaacgtcgtcttcgacatcttcacggccaacggcgccgacatggtcttcaccgagtacggcgatcactggcgccgcatgcgccgcgtcatgacgctgcccttcttcacggcgcgcgtcgtgcagcagtaccgcgccatgtgggaggccgagatggacgacgtcgtgtccgacctgcgcggcggctccgccgcccgcggccccggcgtcgtcgttcgccgcaggctgcagctcatgctctacaacatcatgtaccgcatgatgttcgacgcccgcttcgagtccgtggacgaccccatgttcgtggaggccaccaagttcaactcggagcgcagccgcctggcgcagagcttcgactacaactacggcgacttcatccccatcctcaggcccttcctgcgtggctacctcaacaaatgcagggacctgcagaccaggaggcttgccttcttcaacagcaactacgtcgagaagagaaggaaggtgatggacacgccgggggacaagaacaagctccgatgcgcgatcgaccacatcctcgcagcggagaagagcggcgagatcacgccggagaacgtcatctacatcgtcgagaacatcaacgtcgcggccatcgagacgacgctatggtccatcgagtgggcgctggccgaggtcgtgaaccacccggacgtgcagcgcaaggtccgcggcgagatcagggacgtgctcggcgacgacgagcccatcaccgagtccaacatcagcaagctgccgtacctgcaggccgtgatcaaggagacgctgcggctgcactcccccatcccgctcctcgtcccccacatgaacctcgaggaggccagcctcggcggctacaccattcccgagggctccaaggtcgtcgtcaacgcctggtggctggccaacaacccggagctgtgggagaagccggaggagttcaggccggagagattcttgggcgaggagagcaacgtggacgccacggtcggcggcaaggtggacttccggttcctcccgttcggcgtgggccggcgcagctgccccggcatcatcctcgcgctgcccatccttgcgctcatcgtcgggaagctcgtgaggagcttcgagatggtgcccccgccaggcgtggacaagctcgacgtgagcgagaaaggcgggcagttcagcctccacattgccaaccattccctcgtcgcattccaccccatctcagcatgagcaattcattacttcaacccaaaagcctgttctacatgcacatttactttatccacctcatcagcgaccgacacgtagcagcgcccatgatttaaggggtttgcatttttttaaaaggaggatcgtccctcgcgtgttcataaagggtttacataatgcttttaagctttaagaaatcggtttacatgatgcttttcagctttaagaaatgcatgtattttgcaaa

SEQ ID NO: 358 - DNA, 1876 bp, Aegilops tauschii
cagcaaccaacagcatagcatcagcaccagttcaaacacacatacattgcacgccaagctagcactcgcgcacagcacagcatggctgtctccgcgcgcagcgcggccttcgccacggcagcctccttggccgtgtactggctccttacatcgttcctccacgcaccgcaccccgcgctgctgccggcagcggccgccctcgtcgccgtcgccatcgcagcgggagcgggtcggaagcgtggcggcgccggcgcccctcccggccccgcggccgtgccggtgttcggcaactggctgcaggtgggcaacgacctcaaccaccgcttcctagcgcggctgtcggcgcggtacggccccgtgttccggctgcggctgggcgtgcgtaacctggtggtggtgtcagaccctcagctggccacggaggtgctccacacgcagggcgtggagttcggctcccgcccgcggaacgtcgtgttcgacatcttcacggccaacggcgccgacatggtcttcaccgagtacggcgaccactggcgccgcatgcgccgcgtcatgacgctgcccttcttcacggcgcgggtcgtgcagcagtaccgctccatgtgggaggccgagatggacgacgtggtgtccgacctgcgcggcgactccgccgcccgcggggccggcgtcgtggtgcgccgccggctgcagctcatgctctacaacatcatgtaccgcatgatgttcgacgcccggttcgagtccgtggacgacccaatgttcgtggaggccaccaagttcaactcggagcgcagccgcctggcgcagagcttcgactacaactacggcgacttcatccccatcctcaggcccttcctgcgtggctacctcaacaagtgcagggacctgcagaccaggaggctggccttcttcaacgccaactacgtcgagaagagaaggaaggtgatggacacaccaggagacaaaaacaagctccgatgcgcgatcgaccacatcctcgcagcagagaagagcggcgagatcacgccggagaacgtgatctacatcgtggagaacatcaacgttgccgccatcgagacgacgctatggtccatcgaatgggcgctcgccgaggtggtgaaccacccggaagtgcagcgcaaggtccgcggcgagatcagggacgtgctcggcgacgacgagcccatcaccgagtccaatatcagcaagctgccgtacctgcaggccgtgatcaaggagacgctgcggctgcactccccgatcccgctcccgccccctcacatacccctcgaggagcccagcctcggcggctacaccattcccaagggctccaaggtggtggtcaacgcctggtggctggccaacaacccggagctatgggagaagccggaggaattcaggccggagaggttcttgggcgaggagagcaacgtggacaccacggtcggcggcggcaaggtggacttccggttcctcccgttcggcgtgggccggcgaagctgccccggcatcatcctggcgctgcccatcctggcgctcatcgtggggaagctggtgaggagcttcgagatggtgcccccgccaggcgtggacaagctcgacgtgagcgagaaaggcgggcagttcagcctgcacatcgccaaccattccgtcgtcgccttccaccccatcgtctcaccatgaccaattacttcaaccgaaaagcctacacggctacacggctacacgcacaattactcttctcgggttacaaatatattacaggaaagtatgtcagttgattcaaggggtttactttttttgttgttgaaaaggagaggatcacccctgtgcataaggggtttacataatgctttttcagctttaagaaatg

SEQ ID NO: 359 - DNA, 2137 bp, Oryza sativa
agcagccacagctcgctttgcaattccaccaactaaaatcaaaccaccaaaacacaacacagggacgtatcgcacagccagtgagcgggtctagttcgagcagcatggcggcctccgcgatgagggtggccatcgccaccggggcgtcgttggcggtgcatttgttcgtcaagtcgttcgtgcaggcgcagcatcctgctctcaccttgctgctgccagtggctgtgtttgtcggcattgcggtgggcgcgaagggcgggagcggtggtgacgggaaggcgccgccggggccggcggccgtgccggtgttcggcaactggctgcaggtgggcaacgacctgaaccaccggttcctcgcggcgatgtcggcacggtacggtcccgtgttccgtctgcggctgggcgtgcgcaacctggtggtggtgtcggacccgaagctggcgacggaggtgctgcacacgcagggcgtggagttcggctcccgcccgcgcaacgtcgtcttcgacatcttcaccgccaacggcgccgacatggtgttcaccgagtacggcgaccactggcgacgcatgcgccgcgtcatgacgctgccgttcttcacggcgcgcgtcgtgcagcagtacaaggccatgtgggaggccgagatggacgccgtcgtggacgacgtgcgcggcgacgcggtggcgcagggcaccggcttcgtggtgcgacgcaggctgcagctcatgctgtacaacatcatgtaccggatgatgttcgacgcgcggttcgagtcggtggacgaccccatgttcatcgaggccaccaggttcaactccgagcgcagccgcctcgcgcagagcttcgagtacaactacggcgacttcatccccatcctccgtcccttcttgcggggctacctcaacaagtgccgtgacctccagagcaggaggctcgccttcttcaacaacaactacgtcgagaagagaaggaaggtgatggacactccgggagacaggaacaagctccggtgcgcgatcgaccatatccttgaggcggagaagaacggcgagctgacggcggagaacgtgatctacatcgtggagaacatcaacgtggccgccatcgagacgacgctctggtccatcgagtgggcgctggccgaggtcgtcaaccacccggcggtgcagagcaaggtccgcgccgagatcaacgacgtgctcggcgacgacgagcccatcaccgagtccagcatccacaagctgacttacctgcaggccgtgatcaaggagacgctgcggctgcactccccgatcccgctgctggtgccgcacatgaacctggaggaggccaagctcggcgggtacaccatccccaagggatccaaggtggtggtgaacgcgtggtggctggccaacaacccggcgctgtgggagaaccccgaggagttccggcctgagcggttcttggagaaggagagcggcgtggacgccaccgtcgccgggaaggtggacttcaggttcctgcccttcggcgtgggccgccgcagctgcccggggatcatcctggcgctgcccatcctggcgctcatcgtcgggaagctggtgaggagcttcgagatggtgccgccgccgggcgtggagaagctggacgtgagcgagaaaggcgggcagttcagcctccacatcgccaagcactccgtcgtcgccttccaccccatctctgcctgaactcatcgaatccctttgaatcaagttcgtgccatcagtcgataaatccaattaaaatttttgtttgtttataaaattgcagaagaataggttataaatgacagcttacagcatgttttcagttttgtttcctaaagagtgtaatttgaaaagtgaaatggaattgtcatccaactagtgtgagaaagtgctctgctttgcgtaaaaagaaatgtgctctgctctgctctgttctgttatctcttcctttgtagtctgactgtatgttcagaacattatccattttcctgtgttgcggtcttgcggatgcccgtgcgaagaagagcaaaggtcatcttcttcaatcttcatcaccggcatatcgctggcacagccgacgctgattagttcggcatgtattccttttgcgaccttggaggcttggatggatt

SEQ ID NO: 360 - DNA, 2313 bp, Oryza sativa
atagatttccgcccaaaaccatccaccttttgccgcctccgctcgtgcgcagcagcgcagctgccttgccgtttcccaattcccacacgccatgacgccaaccaacccaagcacagcagtacaccacacgatgtcacgactcacggacacacgggctatatatatcgacgtgccacaccacaccgtacccaagcaaacagatttccaactaaacttgtaccaaaacacaaacgacatcggtcccagtcaagcggagcgcacgaacacaacgcagagcatggcagcctccgtggtgagggtggccatcgccaccggggcgtcgttggcggtgcatttgttcgtcaagtcgttcttgcaggcgcagcatcctgctctcaccttgctgctgccggtggctgtgtttgccggcattgcggtgggcgcgaagggcgggaacgggggcgacgggaaggcgccgccggggccggcggccgtgccggtgttcggcaactggctgcacgtcgggaacgacctgaaccacaggttcctcgcggcgatgtcggcgcggtacgggcccgtgttccgtctgcggctgggcgtgcgcaacctggtggtggtgtcggacccgaagctggcgacggaggtgctgcacacgcagggcgtggagttcggctcccgcccgcgcaacgtcgtcttcgacatcttcaccgccaacggcgccgacatggtgttcaccgagtacggcgaccactggcgacgcatgcgccgcgtcatgacgctgccgttcttcacggcgcgcgtcgtgcagcagtacaaggccatgtgggaggccgagatggacgccgtcgtggacgacgtgcgcggcgacgcggtggcgcagggcaccggcttcgtggtgcgacgcaggctgcagctcatgctgtacaacatcatgtaccggatgatgttcgacgcgcggttcgagtcggtggacgaccccatgttcatcgaggccaccaggttcaactccgagcgcagccgcctcgcgcagagcttcgagtacaactacggcgacttcatccccatcctccgtcccttcttgcggggctacctcaacaagtgccgtgacctccagagcaggaggctcgccttcttcaacaacaactacgtcgagaagagaaggaaggtgatggacactccgggagacaggaacaagctccggtgcgcgatcgaccatatccttgaggcggagaagaacggcgagctgacggcggagaacgtgatctacatcgtggagaacatcaacgtggccgccatcgagacgacgctctggtccatcgagtgggcgctggccgaggtcgtcaaccacccggcggtgcagagcaaggtccgcgccgagatcaacgacgtgctcggcgacgacgagcccatcaccgagtccagcatccacaagctgacttacctgcaggccgtgatcaaggagacgctgcggctgcactccccgatcccgctgctggtgccgcacatgaacctggaggaggccaagctcggcgggtacaccatccccaagggatccaaggtggtggtgaacgcgtggtggctggccaacaacccggcgctgtgggagaaccccgaggagttccggcctgagcggttcttggagaaggagagcggcgtggacgccaccgtcgccgggaaggtggacttcaggttcctgcccttcggcgtgggccgccgcagctgcccggggatcatcctggcgctgcccatcctggcgctcatcgtcgggaagctggtgaggagcttcgagatggtgccgccgccgggcgtggagaagctggacgtgagcgagaaaggcgggcagttcagcctccacatcgccaagcactccgtcgtcgccttccaccccatctctgcctgaactcatcgaatccctttaaattatgattgtgtcaggagcagattaaggatattatacagcattaatttcgatttgtcgaacaaaattagacaatagtaataatgcaagggattttacatgttctgttagaaaatatattttgtgaactgatcttatcattgtcagtaaactagtgtggatagtactgttttccataaaaatcaaatttagtcatttttatctggtgttggtagattgctctggtcgctgactgaatttttttattaattttctttttttatatattttttagaggagggtaaaaactgttttccatgaaaatcaaatttagtcatttttatctggtgttggtagattgctctggtcgctgactgaatattaattttattaattttctattttttattaattttatttatttttttagaggaggg

SEQ ID NO: 361 - DNA, 1514 bp, Zea mays
gtgccttaatttttataaattatactcattttcaaacagtcacactgttgttgttggagatacttatacctgagaaatggctagtaaataaaagcgaaaaaaatgactgggtatgtagggtaacattgatatgcagaaaacgacgcgcagcattcgtggttggctatcaatcaatctatcatgcagagacggggtggaaggcgatgacggagtggttggcaatgtgcaggctgaactgtcctcctttctcgctgacgtcgagcttctccacgccgggcggtggtaccatctcgaagctgcgcacgagcttgccgacgatgagcgcgaggatgggcagcgcgaggatgatcccggggcagctgcggcggcccacgccgaacggcaggaagcggaagtccaccttcccgccaacggtggcgtccacgctcttctcctcgcctaggaaccgctccggccggaactcctcgggcttgtcccacagctccggattgttggccagccaccacgcgttgaccaccaccttggagcccttggggatggtgtagccgccgagcttggcctcctcgaggttcatgtgcgggacgaggagcgggatcggggagtggaggcgcagcgtctccttgatgacggcctgcaggtaggggaggcggtggatggtggactccgtgatgggctcgtggtcggcgacgacggccttgatctcgtcgcggaccttgcgctgcaccgccgggtggttgacgacctccgcgagcgcccactcgatggaccagagcgtggtctcgatggcggcgacgttgatgttctcgacgatgtagatgacgttctccggggtgatctcgccgctcttctccgcctggaggacgtggtcgatggcgcacctgagcttgcccttgtcccccggcgcgtccatgaccttcctcctcttctcgacgtagttgctgttgaagaaggcgagccgcctggcctgcaggtccttgcacctggcgaggtagccgcgcaggaatgggcgcaggacggggatgaagtcgccgtagttgtagtcgaagctctgcgcgaggcggctgcgctcggagttgaacctggtggcctccacgaacatggggtcgtcgacggagccgaagcgcgcgtcgaacatcatcccgtacatgatgttgtagagcatgagctgcagcctgcgccgcacgacgaggccggcggcgcgctgggccgcggaggcgacgtcggagacggcggcgtccatctcggcctcccacatgcccctgtactgctgcacgacgcgcgcggtgaagaagggcagcgtcatgacgcggcgcatgcggcgccagtggtcgccgtactcggtgaacaccatgtcggcgccgttggcggtgaagatgtcgaagacgacgttgcgggggcgggagccgaactccaccccctgcgtgtgcagcacctccgtggcgaggcgcgggtcggagacgaccaccaggttgcgcacgccgaggcggaggcgaaagacgggcccgtaccgcgcg

SEQ ID NO: 362 - DNA, 1156 bp, Sorghum bicolor
ccacacaaatcactagcacgcagtctaagatagcaaccaaaaacatgggcatgattcatacaccatataccatgaagtttagcacaatgcgctgctgcgtgctgcttgtctccttggctctgctcccgctgggcatggccgcggactccatcggcagctactgctcaggaagccgctacgcgggcagcaacaaggccgtgaccagcatcaactccgtcctcgccgacctcgtcgccacggcctccaccggaggcggctacgccacgtccaccgccggcaagggcaacaacatcatctacggcctcgcgcaatgccgcggcgacgtctccgccagcgactgcgcggcctgccttgccgacgccgccaagcagctccccagcacttgcagctacagttccgacgccagaatatggtatgactactgcttcatgcggtacgagaacgccgacttcttcgggcaggcggacacgggcgcgggcgtgatcctggtgaacgtgcaggccatggacaacccgaaggcgttcgagaaggcggtgggaaaagtgatcggcaaggcgacggcgcaggcgtcggcggcgggcagcgcggggctcgggcgggacaaggatcagtacacgccgttcgtgtccatctacgggctggcgcagtgcacgcgggacctcgcgccgctgacgtgcgcgcagtgcctgtccacggcggtgtccaggttcggcgactactgcggcgcgcagcaggggtgccagatcaactacagcagctgcagggtgcgctacgagatctaccccttctacttcccgctcgccggcaacggcggcgccggcggccgcgccaccaccgatatgacgaagaacaccaagatcatcgtgcatccttgatagtttgatttgatacgtgtgtgtgtgtgtaagtaacgcgcaccatgcatgatgacgtggatatatgcgtgcgtgcaagcatgtggcatgtgcacaatacagtaagaatggagtgacttgtgtacgttaacgttgggtaaagtagccttgcgttagcaagtactcccaggaataaagatttgctactgtgttaagcttaagcagtgtaagtgcatatgtgtcgaagcaacgtagcattgtttttctctcataataaatcagcgaacaatactttctaccaa

SEQ ID NO: 363 - DNA, 1026 bp, Echinochloa colona
atggagtttagcacaatgcgccgcttcgtgctgcttgtctccttggccctgctccctctgggaatggccgcggactccatcggcagctactgcgccgggaacagctacgctggcagcaacaaggccgtggccaacatcaactccgtcctcgccgacctcgtctccacggcctccaccggcggctacgccacgtccaccgccggcaagggcaacaacgtcatctacggcctcgcccaatgccgcggcgacgtctccgccggcgactgcgcggcctgcctcgcagacgccgccaagcagctccccagcacctgcagctacagctccgacgcaagaatatggtacgactactgcttcatgcggtacgagaacgccaacttcatcgggcaggttgacacggacgccggcgtgatcctggtgaacgtgcaggcgatgggcaacgccaaggcgttcgagaaggcggtggggaaggtggtcgggaaggcgacggcgcaggcgtcggcgtccggcagcgcggggctcggccgggacaaggaccagtacacgccgttcgtcaccatctacgggctggcgcagtgcacgcgggacctggcgccgctggcctgcgcgcagtgcctgtccacggcggtgtcccggttcggcaactactgcggcgcgcagcaggggtgccagatcaactacagcagctgcagggtgcgctacgagatctacccgttctacttcccgctcgccggaaacggcggcggccgcgccaccaccgacatgaccaagaacaccaagatcgtcgtgcatccttaattgatatgcatgtgtgttgtgtgtaattaacacgcggcatgacgggccgtgcgtgtaaatcatgcatgcgcacttaagcagataaagttggtaagaatggagtgacttgatgtacgttggatataaggctataataagaaatagccttgtgtgtgtaactgggaataaagacgtgctactgctaagcagtttaagtacgtctgcgtcaaagtaatgatatggataaggtag

SEQ ID NO: 364 - DNA, 1210 bp, Setaria italica
caaatcgcttgcatttatcttaaaaagatagcaaacatttgagctttagacacacatggagttcagcacgatgcgccgctcatgcgtgctacttgtctccttggccctgctccctgtgctggggatggccgccgactccatcggcagctactgcgccggtaatagctacgccggcaacaacaaggccgtggccagcatcaactccgtcctcgccgacctcgtcgccacggcctccaccggcggctacgccacgtccaccgccggcaagggcaacaacgtcatctacggcctcgcgcaatgccgcggcgacgtctccgccggcgactgcgcggcctgcctcgccgacgccgccaagcagctccccgccacctgcagctacagctccgacgcaagaatatggtacgactactgcttcatgcggtacgagaacgccaacttcatcgggcaggcggacacggacgccggcgtgatcctggtgaacgtgcaagggatggacaacgccaaggcgttcgagaaggcggtggggaaggtggtcgggaaggcggcggcgcaggcgtcggcatcggggagcggcgggctcgggcgggacaaggaccagtacacggcgttcgtgaccatctacgggctggcgcagtgcacgcgggacctggcgccgctggcgtgcgcgcagtgcctgtccacggcggtgtcccggttcggcgactactgccgcgcgcagcaggggtgccagatcaactacagcagctgcagggtgcgctacgagatctacccattctacttccctctcgccggcaacgccggccgcgccaccaccgacatgaccaagaacaccaagatcgtcgtgcacccttgatgcatttgtctgtgcaacaattagcgcgcatcatgatgtgcatgcgtgcgtgcaagcatatacacacttaagtagaaagtccctaagaatgaagtgatttggtgttggataaggctataaagaatagcctttgcgtgtgtaactgggaataaacatgtgctacatactgctaagcagtttaagtacacgtctgcgtcaaagcagtaatattggtaagttagttacatccagtggccccgaagtgttatgtttcggtcgacacggatgattcggtatgtggatcactctctgtttgcttcttgatcaactatgtacatgtgttcccgagaagatttttcaggacgatccgtagcgaca

SEQ ID NO: 365 - DNA, 837 bp, Saccharum officinarum
ctagcacgcagtctagctaagatagcttgcaaaaaacttgagagcttgatccataccacaaactactatggagtttagcacaatgcgctgctgcattctgcttgtctccttggctctgctcccgcttggcatggccgcggactccatcggcagctactgttccggaagcagctacgctggcagcaacaaggccgagaccagcatcaactccgtcctcgccgacctcgtcgccacagcttccaccggaggcggctacgccacgtccaccgccgggaagggcaacaacatcatctacggcctcgcgcaatgccgcggcgacgtctccgccagcgattgcgcggcctgccttgccgacgccgccaagcagctccccagcacttgcagctacagttccgacgcgagaatatggtacgactactgcttcatgcggtacgagaacgccaacttcttcgggcaggcggacacggatgcgggcgtgatcctggtgaacgtgcaggccatggacaacccgaaggcgttcgagaaggcggtggggaaggtgatcggcaaggccacggcgcaagcgtcggcggcgggcagcgcggtgctcgggcgggacaaggagcagtacacgccgttcgtgtccatctacgggctggcgcagtgcacgcgggacctggcgccggtgacgtgcgcgcagtgcctgtccacggcggtgtccaggtttcgagactactgcggcgcgcaacaagggtgccagaacaactacagcaactgcagggggcgctacgagatctaccctttttacttcccgctggcggcaacggccccggcggacccccccccccggcatgacca

SEQ ID NO: 366 - DNA, 1552 bp, Panicum virgatum
ctttcatctatgaactgtgatgcgcaactgctatctagtcggaggatgaaggggtcgtctacccaagtcaaggagtcatgcatggcgccgatcgagccgccaagccagctagctcgcaatgtctgcaagtgccaagtgcccgtctgcccatgcccacccgtggaccagctgctgactcagcggtcagcactaggactgcaaactcgatctgcatgttaatgtccacatcaaaacggcacgcaaccaaggaaattaaacagtcaaagaacggcagcaaccggaaagcaccgtacctctctgcaatcctaattcctatccgctctccctctatataaacctccaaccatccttcacaggtggagccacacgaatcactagcatcttaataagatagcaagcactcgagctcgacacgcatggagttcatcaggggcagagcgcgccgctgcgtggcgctacttgtctccatggccctgctccctctgctgggaatggccgcggactccatcggcagctactgcgccggcagcagctacgcgggcagcagcaaggccgtggccagcatcaactccgtcctcgccgacctcgtcgccacggcctccacagggggctacgccacgtccaccgccggcaagggcagcgcggtcatctacggcctcgcgcaatgccgcggcgacgtctccgccggcgactgcgccgcttgcctcgccgacgccgccaagcagctccccagcacctgcagctacagctccgacgcaaggatctggtacgacttctgcttcatgcggtacgagaacgccgacttcgtcgggcaggcggacacggacgccggcgtgatcctggtgaacgtgcaagcggcggacaacgccaaggcgttcgagaaggcggtggcgaaggcggtcgggaaggcgacggcgcaggcgtcggcggccggcagcgcggggctcgggcggggcagggaccagtacacggcgttcgtgaccgtctacgggctggcgcagtgcacgcgggacctggcgccgctggcgtgcgcgcagtgcctgtccacggcggtgtcccggttcggcggctactgcggcgcgcggcaggggtgccagatcaactacagcagctgcagggtgcgctacgagatctaccccttctacttcccgctcgccggcgacggccgccgcgccgccaccgacatgaccaagaacaccaagatcgtcgtgcacccttgatatgtgtgtgcgcgtgtgcacgtaataaggcggcacatcatcatgatgtgcttgcacacataagtttgaaagtcgctaaggatgaagggattggcttgatagatgtttgttggataaggctataaagaaatatccgccactatgtagctactgctaagcagttttaagtacatgtctgcgttgaagcaataatattgataagttagctacagaagtggacttgaagtgtgatgattcgatcgtggcgcatgattcggcataatatgtttttcatttctaaccttaaattttcccgccgggagaaaattcgtgtttgatctactttcttttat

SEQ ID NO: 367 - DNA, 761 bp, Brachypodium distachyon
ggcctagcttgcctgcgttgttcctgatcgaatacagaaccaccacagtgcagagacagacatcagacatggctgcctccagattccacatcgcctgcgctctcctcctctttggtgctgtgctactggggcaagacgggaaggccggcatggaggcagtggcttgccctcagtactgtctggaagtggagtacacgacctgcccgtcctccggatccgagaagctcccggcgaggtgcaactgctgcatggcgcccaaaggatgcacgcttcatctctccgatgggaccaagcaaacttgccgttgagcccaagttatgtaacttctgcctgtagactactgcctctagctagtcaaggcagtaacctatctgaacaaacctgctggtttgtcaaataaagcatggcatgcaagtaattatgacatataggagtaatcaagaacgggcatacagttattaccttccggcggcttccatattttcagtgtgtatgttcttccttgctgattaggttcccaagagtagactggtttctaattccggtttcggaaatatttcggccacgactgaaatcactgaaatttagtgaattttagtaatttcggttttcatttcggccaagttaacgaattgaaccaaatttgatatttttttcggaattgctggatctcagtcgactgagaaatagaatttctcagtcgacgagattaattagcgtcgctgagattaattagcgtcgttcgctttatattagctggg

SEQ ID NO: 368 - DNA, 3120 bp, Setaria italica
agcttgccatatttatacctcccttcctcctccttccccggctagagacccacctcctcgccccccgttcttatccccagaagcttcggcaaaagcgatcgatcgatccatccatctccaactccccaccgccgcaccctcctcgtcgcgtcgcggcgcttcgatcctcctctcttcatgcgccatcgccgccacctccgcctctgcagcaccacccgcggataggaataggggtggtggggacgggacaggttggcgatgccttcgctctcctgccacaacctcctcgacctcgctgcggccgacgaggtgcccctgccgtcgcccacgccgctccgcctcccgcgcgtcatgtccgtcgcgtccccggcctcgcccacgtcgccgcccacgccgccgcgccgcgtgatcgtctcccaccgcctgccgctccgcgccgcgcccgacccggccgcgcccttcggcttcgccttcaccgtcgacgccggcaccgtcgcctaccagctccgctcggggctgcccgccagcgcgcccgtcctccacatcggcaccctcccggcggccgcggcggaggcggcctccgatgagctgtccaactacctgctggccaatttctcctgcctgccggtctacctgcccagcgacctccaccaccggttctaccacggcttctgcaagcactacctctggccgctcctccattacctcctcccgctgacgccgtcgtcgctcggcggcctcccgttccagcggacgctctaccactccttcctctcggcgaacagagccttcgccgaccgcctcaccgaggtgctcagccccgacgaggacctcgtctggatccacgactaccacctcctggcgctccccaccttcctccgcaagcgattccctcgcgccaaggtcggattcttcctccactcgccgttcccctcgtcggagatcttccgaacaatccccgtccgggatgacctcgtccgcgccctcctcaacgcggacctcgtcggcttccacaccttcgactacgcgcggcacttcctgtccgcgtgctcccggctgctcggcctggactaccagtccaagcgcggatacattggcatcgagtactacggccgcaccgtcaccgtcaagatactgcccgtcgggatcgacatgggccaactgagatcggtggtctcggcgccggagacgggggacgtcgtgcggcgggtggccgaggcgtacaaggggcggcgcctgatgatcggcgtcgacgacgtcgatctgttcaagggaatcgggctcaagttcttggcgatggagcagctgctcgtggagcacccggagctccgcggccgcgccgtcctcgtgcagatcgccaacccggcgcgcagcgaggggcgcgacgtccagggcgtgcaggatgaggccaaagccatcagcgctcgggtcaatgcgcggttcggcacccctgggtacacgccgatcgtgctcatcgacggcccgttgacggcgcacgagaaggcggcttactacgcggcggccgagtgctgcgtggtgagcgccgtgcgcgacggcctcaaccggataccgtacatctacacggtctgccggcaggagagcaacgcgcttggggaggactcgcccaagcggagcgtcatcgtgctctcggagttcgtcgggtgctccccctcgctcagcggcgcaatccgcgtgaacccgtggagcgtggagtccgtcgcggaggccatgaacgccgccctccggatgcccgaggccgagcagcggctgcggcacgagaagcactacaagtacgtgagcacccacgacgtcgcctactgggcgcggtcgtttgaccaggacctgcagcgcgcctgcaaggaccatttctcgcggcggcattgggggatcggcttcggcatgagcttcaaggtggtggcgctcgggccaaacttccggcggctctctgtcgagcacattgtgccgtcgtaccggaggacggagaaccggctgattctcctggactacgacggcaccgtgatgccggagaattcgatcgacaagacgccaagcagtgaggtcatctctgtcctgaatcgcctctgtgaggaccccaagaacagagtgttcatcgtgagcgggcgggggaaggacgagctgagcaagtggttcgccccatgcgagaagctgggcatcgccgccgagcacggttacttcaccaggtggagcagggacgcgccatgggagacctcagtgttggccgcggacttcgattggaagaagacggccgagccggtgatgcagctgtacaccggggcaacagatggctcctacatcgagcacaaggagagcgccatagtctggcaccaccacgaggcggatccggactttggttcctgccaagcaaaggaactgctcgaccatctcgaaaacgtgctcgccaacgaacccgtggtggtgaagaggggccagcacatcgtcgaggttaacccccagggcatcagcaaaggcgtggttgtggagagcctcctgtcgtcaatggtcaagacggggaagccgccggacttcgtgctgtgcatcggcgacgaccggtcggacgaggacatgttcgagagcatcgtgtgcccgtccaacgccagcgtgaagctcccggccaccagcgaggtgttcgcctgcacggtgggcaagaagccgagcatggccaagtactacctggacgacaccgtggacgtgatcaagatgctggaaggcctggccaacgcgccgtcgcagcggccccggccggcggtgcagctccgtgtctcgttcgaaggttctctgtgaggaagggagaaggaattcattgcacagtagtagtacacatcgaggaagaataaccaatgatatgatggagaagaagattcagacgtgtggtttaggattagctgcagttacaggatcaacaggttttctttttgtttcttcttttaattattcttttacatctctatcccctcttcgttcgtgcctgtatatgccccgtatgataatatgcaagaatgtcccgaccaccttgtatatgaatgtagttgacgatgacgatgaatgaaatcagaaaagggaaaaaaatgattctttcattttgcttgccctgttgcttcc

SEQ ID NO: 369 - DNA, 3487 bp, Panicum virgatum
cggtctccttcttcctcgcttcacacacgacagaggcgcacacgcatatccagctcgccatatttatacctcccccggctagacccacctcgcccgttcttatccccccagaagcttcggcaaaagcgatcgatcccagctcctcctcgtcgcgtcgcggcgcttctcatcccttctcttcatgcgccatcgccgccgcttcagcccctgcgacgccacccgcagataggaaggaacagggaggggacgacaggttggcgatgccttcgctctcctgccacaacctcctcgaactcgctgcggccgacgaggcgcccctgccgtcgcccacgccgctccggctcccgcgcgtcatgtccgtcgcgtccccggcctcgcccacctcgccctcgtcgcccgccccgctgcgccgcgtgatcgtctcccaccgcctgccgctgcgcgcggcgcccgacccggccgcgcccttcgggttcgccttcaccgtcgactccggcaccgtcgcctaccagctccgctcggggctgaccgccaacgcgcccgtcctccacatcggcaccctcccggcggtcgcggcggaggcggcctccgatgagctgtccaactacctgctggcgaatttctcctgcctgccggtctacctgcccagcgacctccaccaccgcttctaccacggcttctgcaagcactacctctggccgctcctccattacctcctcccgctgaccccgtcgtcgctcggcggcctcccgttccagcggacgctctaccactcctttctctcggcgaacagggccttcgccgaccgcctcaccgaggtgctcacccccgacgaggacctcgtctggatccacgattaccacctcctggcgctccccaccttcctccgcaagcgattcccgcgcgccaaggtcggattcttcctccactcgccgttcccctcatccgagatcttccgcacaatccccgtgcgcgacgacctggtccgcgccctcctcaacgcggacctcgtcggcttccacaccttcgactacgcgcggcacttcctgtccgcgtgctcccggctgctcggcctggactaccagtccaagcgcggctacatcggcatcgagtactacggccgcaccgtcacggtcaagatactgcccgtcggaatcgacatggggcagctgagatcggtggtctcggcgccggagacgggggatgcggtgcgccgggtgaccgaggcgtacaaggggcggcgcctcatgatcggcgttgacgacgtcgatctgttcaaggggatcggcctcaagttcctggccatggagcagctgctcgtggaccacccggagctccgcggccgcgctgtgctcgtgcagatcgccaacccggcgcgcagcgaggggcgcgacgtgcagggcgtgcaggacgaggccagggccatcagcgcccgggtcaatgcgcggttcggcacccccggctacacgccgatcgtgctcctcgacggcccggtgacgccgcaggagaaggcggcttactacgcggcggccgagtgctgcgtggtgagcgccgtacgcgacggcctcaaccggataccgtacatctacacggttctccggcaggagagcgacgcgctgggtgacgacacccccaagcggagcgtcatcgtgctctcggagttcgtcgggtgctcgccgtcgctcagcggcgcgatccgcgtgaacccgtggagcgtggagtccgtcgcggaggccatgaacgccgcgctgcggatgcccgaggcggagcagcggctgcggcacgagaagcactacaagtacgtgagcacccacgacgtcgcctactgggccaggtcgtttgaccaggacctacagcgcgcctgcaaggaccacttctcgcggcggcattgggggatcggcttcggcatgagcttcaaggtggtggcgctcggccccaacttccggcggctctccgtcgagcacattgtgccgtcgtaccggaggacggagaaccggctgattctcctagactacgacggcaccgtgatgccggagaattcgatcgacaaagcgcccagcagcgaggtcatttccgtcttgaatcgcctctgcgaggaccccaagaacagagtgttcatcgtgagcgggcggggcaaggacgagctgagcaagtggttcgcgccctgcgagaagctcggcatcgccgcggagcacggttacttcaccaggtggagcagggacgcgccatgggagacctcatcgttggccgccgacttcgattggaagaagacggccgagccggtgatgcagctgtacacggaggcaacagatggctcctccatcgagcacaaggagagcgccttagtctggcaccaccaggaggcggatccggacttcggttcctgccaggccaaggaactgctcgaccatcttgagaacgtgctcgccaacgaacccgtggtggtgaagaggggccagcacatcgtcgaggttaacccccagggcatcagcaaaggcgtggtggtggagagcctcctgtcgtccatggtcaagacggggaaggcgccggactttgtgctgtgcatcggcgacgaccggtcggacgaggacatgttcgagagcatcgtgtgcccgtccaatgccagcgtgaagctcccggccaccagcgaggtgttcgcctgcaccgtgggcaagaagccgagcatggccaggtactacctggacgacacggtggacgtgattaaaatgctggagggcctggcgaacgcgccgtcgcagcggcccaggccggcggtgcagctccgggtctcgttcgagggctcgctgtgagacggaaacgaaaggggaattttactgcacaggaaggagtagtagtacactacacatcgaggacgaataaccaaccaatggtaacgaagatgattcagacgcgtggtttaggattagctgcagtagttacaggatcaacaggttttctttttttttgtttctttttttcattcttttacatttttacccccctcttcggtcgtgcgcctgtatatgccccgtatgataatgcaagaatgtacgtgcccttgtatatgtagttgacgatgacgatgaaatctgaaaaagggaaaaaaatattctttcactttgcttgccttgttgcttgatcatctgttcctggcagtcccattcagccacgcctttcgcctttgctgcatcatacaatcccatctcagtatggatgccgcccggatagcaccagcctgacccctgatctggtgctccttatccgccccaccaagctgcggcgcttgacggcaacaggagtcgccgagcgaggctgccatgtccggctcgttgctagctgtaagaacgaaaattgtcgagatctagcgacgggagccctaattatgattgccaacttgcagctcgtatggtggcgtcctgcacgcctgaagtagacgtttcctaggattaggaaaggttttgataacaagaaaccgcaagggtttagg

SEQ ID NO: 370 - DNA, 3323 bp, Panicum virgatum
cccacgtcgcggcgggggcagtcccgtcatttgccatcggagaaattgtggataaggcccccagccatcgacagaggacggaggcacacgcatatccagctcgccatatttatacctccccctcctcctcccccggctgcgcccgttcttacccccccccccccacccacccaccagaagaagaagcttcggcaaaagcgatcgatccgtccgcctcccagctcctcctcgtcgcgtcgcggcgcttctccacccttctcttcatgccccatcgccgccgctccagcctctgcgacgccacccgcggataggaacagggagaggggacgacaggttggcgatgccttcgctctcctgccacaacctcctcgacctcgctgcggccgacgaggtgcccctgccgtcgcccacgccgctccggctcccgcgcgtcatgtccgtcgcgtccccggcctcgcccacctcgccctcgccgcccgccccgccgcgccgcgtcatcgtctcccaccgcctgccgctgcgcgcggcgcccgacccggccgcgcccttcgggtttgtcttcaccgtcgactccggcaccgtcgcctaccagctccgctcggggctgcccgccagcgcgcccgtcctccatatcggcaccctcccggcggccgccgcggaggcggcctccgatgagctgtccaactacctgctggcgaatttctcctgcctgccggtctatctgcccagcgacctccaccaccgcttctaccacggcttctgcaagcactacctctggccgctcctccattacctcctcccgctgacgccgtcgtcgctcggcggcctcccgttccagcggacgctctaccactccttcctctcggcgaacagggccttcgccgaccgcctcaccgaggtgctctcccccgacgaggacctcgtctggatccacgattaccacctcctggcgctccccaccttcctccgcaagcgattcccgcgcgccaaggtcggatttttcctccactcgccgttcccctcatcggagatcttccgcacaatccccgtgcgggacgacctggtccgcgccctcctcaacgccgacctcgtcggcttccacaccttcgactacgcgcggcacttcctgtccgcgtgctcccggctgctcggcctggactaccagtccaagcgcggctacatcggcatcgagtactacggccgcaccgtcacggtcaagatactgcccgtcggaatcgacatggggcagctgagatcggtggtctcggcgccggagacgggggacgccgtgcgccgggtggccgaggcgtacaaggggcggcgcctgatgatcggcgtcgacgacgtcgacctgttcaaggggatcggcctcaagttcctggccatggagcagctactcgtggaccacccggagctccgcggccgcgccgtgctggtgcagatcaccaacccggcgcgcagcgaggggcgcgacgtgcagggcgtgcaggacgaggccagggcgatcagcgcccgggtcaatgcgcggttcggcacccccggctacaccccgatcgtgcttctcgaaggcccggtgacgccgcaggagaaggcggcttactacgcggcggccgagtgctgcgtgatgagcgccgtgcgcgacggcctcaaccggataccctacatctacacggtcctccggcaggagagcgacgctctcggtgacgacgcccccaagcggagcgtcatcgtgctctcggagttcgtcgggtgctccccgtcgctgagcggcgcgatccgcgtgaacccgtggagcgtggagtccgtggcggaggccatgaacgccgcgctgcggatgcccgaggcggagcagcggctgcggcacgagaagcactacaagtacgtgagcacccacgacgtcgcctactgggccaggtcgtttgaccaggacctgcagcgcgcctgcaaggaccacttctcgcggcggcattgggggatcggcttcggcatgagcttcaaggtggtggcgctcggccccaacttccggcggctctccgtcgagcacattctgccgtcgtaccggaggacggagaaccggctgattctcctggactacgacggcaccgtgatgccggagaattcgatcgacaaggcgcccagcagtgaggtcatctccatcctgaatcgcctctgcgaggaccccaagaacagagtgttcatcgtgagcgggcggggcaaggacgagctgagcaagtggttcgcgccctgcgagaagctcggcatcgccgcggagcacggttacttcaccaggtggagcaggggcgtgccatgggagacctcatcgttggccgccgacttcgattggaagaagacggccgagccggtgatgcggctgtacacggaggcaacagacggctcctccatcgagcacaaggagagcgccttggtctggcaccaccaggaggcggatccggacttcggctcctgccaggccaaggagctgctcgaccacctcgaaaacgtgctggccaacgaacccgtggtggtgaagaggggccagcacatcgtcgaggttaacccccagggcatcagcaagggcgtggtggtggagagcctcctgtcgtccatggtcaagacggggaaggcgccggacttggtgctgtgcatcggcgacgaccggtcggacgaggacatgttcgagagcatcgtgtgcccgtccaacgccagcgtgaggctcccggccaccagcgaggtgttcgcctgcaccgtgggcaagaagccgagcatggccaggtactacctggacgacacggtggacgtgatcaagatgctggagggcctggccaacgcgccgtcgcagcggcccaggccggcggtgcagctccgggtctcgttcgagggctcgctgtgagagacgaaacaacggaagggggattttactgcacaggaaggagtgacgaataaccgaccaatggtgacgaccaagatgattcagacgcgtgctttaggattagctgcagttacaggatcaacaggttttctttctttggtttctttttttcattcttttacatttctacccctcttcggccgtgcctgtacatgccccgtatgataatatgcaagaatgtatcgaccaccttgtacatgtagttgacgatgacgatgaaatcagaaaaaaagaaacaacaaaaggattctttcactttgcttgatctgttcctggcagtcccattcagccacgcctttcgcctttgctgcattatacaatcccagctcagtatggatgccccccgatagcaccagcctccctgatctggtgctccttatccgccccaccaagg

SEQ ID NO: 371 - DNA, 3455 bp, Setaria italica
cttcggcaacagcaatcgaccatccatccatctcccaactccccccaccgccgaaccttcctcgtctcctcgcggcgcttagatcatcttctcttcatgcgccatcgccgccgcctccgcctctgcgacaccacccacagataggagtaggggtggggacgggacaggttggtgatgccttcgctctcctgccacaacctcctcgacctcgctgcggccgacgaggtgcccctgccgtcaccaacgccgctccgcctcccgcgcgtcatgtccgtcgcgtccccggcctcgcccacctcctcgccgtcgccacccgccacgccgcgccgcgtgatcgtctcccaccggctgccgctccacgccgcgcccgacccggccgcgcccttcggcttcgccttcaccgtcgacgccggaaccgtcgcctaccagctccgctcggggctgcccgctagcgcgcccgtcctccacatcggcaccctcccggcggccgcggcggaggcggcctccgacgagctgtccaactacctgctggccaatttctcctgcctgccggtgtacctgcccagcgacctccaccaccgattctaccacgggttctgcaagcactacctctggccgctcctccattacctcctcccgctgacgccgtcgtcgctcggcggcctcccgttccagcggacgctctaccactccttcctctcggcgaacagggccttcgccgatcgcctcaccgaggtgctcaaccccgacgaggacctcgtctggatccacgattaccacctcctggcgctccccaccttcctccgcaagcgattcccgcgcgccaaggtcggattcttcctccactcgccgttcccctcatcggagatcttccgaacaatccccgtgcgggatgacctcgtccgcgccctcctcaacgccgacctcgtcggcttccacaccttcgactacgcgcggcacttcctgtccgcgtgctcccggctgctcggcctggactaccagtccaagcgcggctacatcggcatagagtactacggccgcacggtgatggtcaagatactgcccgtcgggatcgacatggggcagctgaggtcggtggtctccgcgccggagacgggggatgcggtgcggcgggtggccgaggcgtacaaagggcggcgcctcatgatcggcgtcgacgacgtcgatctgttcaagggaatcgggctcaagttcctggcgatggagcagctcctcctggagcacccggagctccgcggccgcgccgtgctcgtgcagatcgccaacccggcgcgcagcgaggggcgcgacgtacagggcgtgcaggatgaggccaaagccatcagcgcccgggtcaatgagcggttcagcaccgccgggtacacgccgatcgtgctcatcgacggcctggtgacggagcaggagaagtcggcttactacgccgcggccgagtgctgcgtggtgagcgccgtgcgcgacggcctcaaccggataccgtacatctatactgtgtgccggcaagagagcaacgcgctgggggacgactcccccaagcggagcgtcatcgtgctctcggagttcgtcgggtgttctccgtcgctcagcggcgcgatccgcgtgaacccgtggagcgtggagtccgtagcggaggccatgaacgccgcgctgcggatgcccgaggccgagcagcggctgcggcacgagaagcactacaagtacgtgagcacccacgacgtcgcctactgggcgcggtcatttgaccaggacctgcagcgcgcctccaaggaccatttgtcgcggcggcattgggggatcggcttcggcatgagcttcaaggtggtggcgcttgggccaaacttccggcggctctatgtcaagcacattgtgccgtcgtaccggaagacggagaaccggctgattctcctggactacgacggcactgtgatgccggagaattcgatcgacaagacgccaagcagtgaggtcatctccgtcttgaattgcctctgtgaggaccccaagaacagagtgttcatcgtgagcgggcgggggaaggacgagctgagcaagtggttcgccccctgcgagaagttgggcatcgccgcggagcacgggtacttcaccaggtggagcagggacacgccatgggagacctcagtgttggccgcggacttcgattggaagaagacggccgagccggtgatgcagctgtacaccgaggcgacagatggctcctacatcgagcacaaggagagcgccatcgtctggcaccaccacgaggcggatccggacttcggttcctgccaagcaaaggaactgctcgaccatctcgaaaacgtgcttgccaacgaacccgtggtggtgaagaggggccagcacatcgtcgaggtgaacccgcagggcatcagcaaaggcgtggttgcggatagcctcctgtcgtccatggtcaaaacggggaagccgccggatttcgtgctgtgcatcggcgacgaccggtcggacgaggacatgttcgagagcatcgtgtgcccgtccaacgccagcgtgaagctcccggccaccagcgaggtgttcgcctgcacggtgggcaagaagccgagcatggccaagtactacctggacgacaccgtggacgtgatcaagatgctggaggccctggccaacgcgacgtcgcagcggccccggctggcggtgcagctccgggtctcgttcgagggctcgctgtgaggaaggagaaagaattcattgcgcagtagcagtacatcgaagaaggttcagacgtgtggtttaggattagctgcagttacaggatcaacaggtgttttgtttctttttttattattattcttttacatctctacctcctcttcgtccgtgcctgtatacgcccgtacgataatatgcaagaatgtctcgaccaccttgtatatgtatgtagctgatgatgatgatgaaatcagaaaagtagaaaagttttaaaaaataattctttcactttgctagccctgttgcttcccctggcgtggagcacataaacatctaattcctctatgagcccgtaaataaaccctgctaaaattcataatctacacctagaactttactgcaaattcagatcaccatgtaaaatagctgaggaatttaaaaagcaactgctaatctatgtatcctcctaaatattgcaactaataatctatgtacctcctaaatattgcaagtcatgctatctacacatttcctttttctgaaattatgtcataaacatgccaacactgtcacgaggactactccctccgtcccgcaaagagtttccttttaggtttgtgctaagtcaaactattttatgtttgaccaaatttacaataaagagtatcaatatttataacactaaataagtatgctatgaaaatatatttcataacaaatctaacgaaacttgttagacatcaaaagca

SEQ ID NO: 372 - DNA, 3052 bp, Oryza sativa
atttatagctcgtcctctcttctctcccaccctcgtccgttcttatccacctccacgcccatcacgcttgcggccgtttccatccttccgcttcatcggagtagttcgccgccgggttgggttttcttcttctcttgatgcgacgtggaggcggcgagttgttcgtcgggtgcacgaaccggtgatttttttttgttttggcgatgccttcgctctcctgccacaacctcctcgacctcgttgccgcggcggacgacgcggcgccgtcgcccgcgtcgctgcgcctcccgcgcgtcatgtcggcggcgtcgccggcctcgcccacgtcgccgtccacgccggcccccgcgcggagggtggtcgtgtcgcaccgcctcccgctccgcgccgcggccgacgcggcgtcgccgttcgggttctccttcacggttgactcggacgccgtcgcgtaccagctccgctcggggctgccccccggcgcgcccgtcctccacatcggcacgctcccgccgcccgcaaccgaggcggcctccgacgagctctgcaactacttgctggcgaacttctcttgcctgccggtgtacttgcccgccgatctccaccgccgattctaccatggattctgcaagcactacctgtggcctctcctccattaccttctgccgctcacgccgtcgtcgctgggcgggttgccgttcgaccgcgcgctctaccattctttcctctcggcgaaccgggccttcgccgaccgcctcaccgaggtgctcagccccgacgacgacctcgtctggatccacgattaccacctccttgccctccccaccttcctccgcaagcgattcccgcgcgccaaggtcggtttcttcctccactcgccgttcccctcctcggagatcttccgcaccattcccgtcagggaggacctcctccgcgccctcctcaacgccgacctcgtcggcttccacaccttcgactacgcgcgccacttcctctccgcctgctcgcggctgctcggcctggattaccagtccaagcgcggctacatcggcatcgagtactatggtcgcaccgtcacggtcaagattctgcccgtcgggatcgacatgggccagctgaggtcggtggtgtcggcgccggagacgggggacctggtgcggcggctcaccgagtcgtacaaggggcggcgcctgatggtcggcgtcgacgacgtcgacctgttcaagggaatcgggctcaagttcctggcgatggagcagctgctggtggagcacccggagctgcgcggccgcgcggtgctcgtgcagatcgcgaacccggcgcgcagcgaggggcgcgacatccaggaggttcagggagaagccagggcgatcagcgcccgcgtcaatgcgcggttcggcacgccggggtacacccctatcgtgctgatcgaccgcggtgtgtcggtgcacgagaaggcggcgtactacgcggcggccgagtgctgcgtggtgagcgccgtgcgggacggcctcaaccggataccctacatctacacggtgtgccggcaggagagcactggcctggatgatgcggccaagcgcagcgtcattgtgctgtcggagttcgtcgggtgctccccgtcgctcagcggcgcaatccgggtcaacccatggagtgtggagtctatggcagaggccatgaatgcagccctgaggatgcctgagccagagcagcggctgcgacatgagaagcactacaagtatgtgagcacccatgatgttgcctactgggcgaaatctttcgaccaggacctgcagcgagcttgcaaggatcatttctcgcggcggcattggggtattgggtttgggatgagtttcaaggtggtggcacttggcccgaatttcaggcggctgtctgtcgatcacattgtgccgtcataccggaagtctgataatcgcttaattctcttggactatgatggcacagtgatgccagagggttcaattgataaggcaccgagcaatgaggtcatctctgtattgaatcgtctgtgcgaggaccccaagaacagagtgttcatcgtgagcggtagagggaaggatgaacttggcagatggtttgcaccttgtgagaagctggggattgctgcagagcatggttacttcacaaggtggagcagggactcagcttgggagacctgcgggttggccgtggactttgattggaagaagactgcagaaccagtgatgaggctttacaaggaggcaacagatggttcaaccatcgaagacaaggaaagcgcgttagtttggcaccacgatgaggcagatccagattttggttcatgccaggcaaaggaactgcttgaccacctcgaaaacgttcttgcaaatgaaccagtcgttgttaagaggggccagcatatcgtcgaagtaaatccacagggcatcagcaaaggtgtggttgtggacaacctcttgtcatccatggtgagccgagggaaggcgcccgatttcgtgctgtgcattggggacgaccggtcggacgaggacatgttcgagagcatcgtttgcccgtcgaacagcagcgtcaagctcccggcgagcagcgaggtgttcgcctgcacggtcggcaagaagccgagcatggccaagtactacctcgacgacacggtcgacgtgatcaagatgctgcagggtctcgccaatgcgccatcgcagcggccaaggcaagtgcagctgcgggtctcgttcgaaggctcactgtgacggagacagggattattctgcacagtataaaaaccaaggaggaaattccaataacaaatggaaaagatgatgatgattcagttcgtgtggtttaggggttagctgcagaagttacaggataaacaggtttttttttgtttttttttcttctttttctttcaacattttcagccttcttccatgcttgtatatgccccgtatgataaaaatatgcgagaaggtttcagccaccttgtatatgtagttgacgatgacgatgaaatcagaaccaaaaaaaaaaaaaaggaaaaatgattctttcttca

SEQ ID NO: 373 - DNA, 3947 bp, Brachypodium distachyon
ggcacttaatacagtaggctccgtatgatggagtaagtacattttacggataacacgtctaagatagtaaattacaaacagtggtcctttataatccctgcactgcgtgggtgcgcacggcaggcgactacgtgtgcagacgcgacgtattcctcccgtctgcggcagcagcagcagcccggccgcagcgacgtcaatggttagatagatagagaggtggataaacccagccgttaggcgaccgcgacattcgtctatccacacccatcatccaaaccgtccctcgccgcaggggcatgaccgtcaatttccatcgccccgtttccaatctggataagcctcgagaccccgcccccgaccccgcccccaccgcctgctacctcctccgcgccgggtctcctccgcctccctccttcttccaccttggcttccatctgggattggggatttaggatcccctcacgcctccgtatttatactccgtttctccccaccccccaccgttcttatccccagaagcttctacaaaagtggcccatcccgtcgatctcgctcttcttctccattccctccggactctctcttcccccatcttcatgcgccatcctcgtctcctcaccctctgcagatataggatcgtacgggggaagctgtaggaggaggagtagtagtgctcggtggtgatgccttccctctcctgccacaacctgctcgacctcgccaacgcggcgaccgacgagctgccgccactgccgccgccgtcgccgctccgcctcccgcgcgtcatggcctccggctctccctcctcgccggcctccccttccccttccgcgccgccgcgccgggttatcgtctcccaccgcctcccgctccgcgccgcgcccgacgcggccgccccgttcgggttctccttcaccgtcgatgcgagcaccgtcgcgtaccagctccgctcgggcctgccgccgtcggccccggtcctccacatcggcacgctcccggcggccgccgccgaggatttctccgacgagctcgccgcctacctgctggccaacttctcctgcctgcccgtctacctccccgccgacctccaccgccgcttctaccacggcttctgcaagcactacatgtggccgctcctccactaccttctcccgctgaccccgtcgacgctgggcgggctcccgttcgaccgctcgctctaccactccttcctctcggccaatcgggccttcgccgaccgcctcaccgaggtgctcagccccgacgacgacttcgtctggatccaggactaccacctcttcgccctccccaccttccttcgcaagcgcttcccgcgggccaaggtcggcttcttcctccactcgccgttcccctcctccgagatcttccgcaccattcccgtccgggatgacctcctccgcgccctcctcaacgccgacctcgtcggcttccacactttcgactacgcgcggcacttcctctccgcgtgctcccggctgctcggcctggattaccagtccaagcgcgggtacatcggcatcgagtactacggccgcacggtcacggtaaagatactgcccgtcgggatcgacatggggcagctgaggtcggtggtgtcggcgccggagacaggggaggtggcgcggcaggtggccgaggcgtacaaggggcggcgcctgatgctgggcgtagacgatgttgatctcttcaaaggaatcgggctcaagttcctgggtatggagcaactgctggtggagcaccctgagctccgtggccgtgccgtgcttgtgcagattgccaatccggcccgcagcgaggggcgcgacgtgcaggaggttcaggacgaggcaagggcaattagcgcccgggtcaacgagcggttcggctcgcctgggtacaccccaatcgtgatgatcaaccgtccggtgtcggtgcacgagaaggcggcatactatgccgctgccgagtgctgcgtggtgagcgccgtccgggacgggctcaaccggataccttacatctacacggtgtgccggcaggaaagcaccacccaggaggaagcgcctaagcgaagcgtcatcgttctgtccgagttcgtaggatgctcaccatcgctcagtggggcgatccgggtcaacccatggagcgtggagtctgttgcggaggccatgaacgcggcattgatgatgtctgagggggagcagcggctgcggcacgagaagcattacaagtatgtgagcacccatgatgtcgcctactgggcgcggtcatttgaccaggatctgcagcgagcctgcaaggatcatttctcccggcggcactggggtatcggtttcgggatgagcttcaaggtggtggcacttggcccaaatttcaggcggctttctgtcgagcacattgtgccgtcattccggaagacggacaatcggctaattctcctggactatgatggaaccgtgatgccagagagttcaattgacaaggcaccgagcaacgaggtcatttctgtcttgaatcgtctgtgtgaggatccaaagaacagggtgttcattgtgagcggacgggggaaggatgaactgagcaagtggtttgcgccatgtgagaagctggggattgctgcggagcatggttactttaccaggtggagcaaggattctccatgggagacctgcgggttggcagtagacttcgattggaagaagaccgctgagccggtgatgaggctttacacagagtcaacagatggttcgtatatcgagcataaggaaagcgctctcgtttggcatcaccatgaggcggatccggatttcggttcatgccaggcaaaagaactgcttgaccatctcgaaagcgtgcttgcgaatgagccagttgttgtgaagaggggccagcacatcgtggaagttaatcctcagggcatcagcaagggcgtggttgtggagagcctcctgtcatccatggtgcgcagcgggaaggcgcctgatttcgtgctctgcattggggacgaccggtccgacgaggacatgttcgagagcattgtgtgcccgacgaacagcagcgttaagctcccggcgaccagcgaggtgtttgcctgcacggttgggaagaagccgagcatggccaagtactacctcgacgacacggtggacgtcattaagatgctgcaggggcttgccaatgcgccattgcaacagcggccatggccggtgcagctccgggtcaccttcgaaggctcgctgtgagaaagaaaggaacggatttcactgcacagtatgaaccgatgaggggttcaataaccaaaagaagaacgatcgacggttcagtatggcttaggattagctccagttacaggataaacaggtttctttcttttttttgggttcacatttccagcccttcttctcttatgcacttatatcatatatgcccgtatgataaccgccagaaaggtttctgtcacattgtatatgtagttgacgatgacgatgaaatcagatgaagaaaaatgattctttgagccatgatctgaatgcccaccgggcggatagcgccggcgtccagctcaggtgctccttatcttctgcaactccgcaccatttcgtcgccagtcgtttgacggccaaagagaggcgagattttaagtttcaggcaagacaacgggagccaaccctagcataattgccaaaaaaaaacttcatatcgtatggggtaattgccagctttcacttgatcacttcgccattaggatatttgtttggagggtgaccaaaacggacctcggtaatactttggaatgacaaaagaaagttgatatattcgttgccgatgctcctttgtccattctagtccagttttttctctctatcatatgggaagcagaaccaggatggttttttggcaaaagaattttttttttttggtactacaagtttggtagtaccaaaatcaaa

SEQ ID NO: 374 - DNA, 3006 bp, Triticum aestivum
gaagcttccaccgacttggcaaccccatcctcctcctccccctcttctccctctgcattcccacgcggccctcgccgtctcttcatgcgccattcccgtctagcagcactgggcatctgcggcgcgcaccggtagaaccaaggatcggatcggaccggcgatgccgtcgctctcctgccacaacctgctcgacctggccgacgagctgcccccgctccccccgtccccgctccggctcccgcgggtcatggcgggcgcctccccctcctcgccggcctccccgtccccttccggcccgcctcgccgcgtcatcgtctcccaccgcctgcccctccgcgcgtcccggaccccgcggcgccgttcgggtttaaattcaccgtcgacgcgggcaccgtcgcctaccagctccgctcgggcctccccgccgcggcccccgtgctgcacgtcggcacgctgcccccgccgcggcagaggcggcctccgacgagctggccagctacctcgtgtccgccttctcctgcctgcccgtcttcctccccgccgacctccacggcaagttctaccacggcttctgcaagcactacatgtggccgctgctccactacctgctcccgctcacgccctccacgctcggcggcctgcccttcgaccgcgcgctctaccactccttcctctccgccaaccgcgccttcgccgaccgcctcaccgaggtgctcgcccccgacgacgacttcgtctggatccaggactaccacctcctcgccctccccaccttcctccgcaagcgcttcccgcgcgccagggtcggattcttcctccactcccccttcccctcctccgagatcttccgcaccatccccgtccgcgacgacctgctccgggcgctcctcaacgccgacctcgtcggcttccacaccttcgactacgcgcgccacttcctgtcggcgtgctcgcgcctcctcggcctcgattaccagtccaagcgcgggtacatcggcatcgagtactacggccgcaccgtcaccgtcaagatactgcccgtcggcatcgacatgggccagctccgctcggtcgtgtcggcgccggagacggccgacgtggtgcgccaggtcgccgacgcctacaaggggcggcgcctcatgctgggcgtggacgacgtcgacctcttcaaggggatcgggctcaagttcctggggatggagcagctcctggtggagaaccctgagctccgcggcaaggccgtgctcgtgcagatcaccaatccggcgcgcagcgagggccgggacgtgcaggaggtgcaggacgaggccagagccatcagcgcccgggtcaacgagcggttcggcagccccgggtacaccccgatcgtgatgatcagccgcccggtgtcggagcacgagaaggcggcctactacgccgccgccgagtgctgcgtggtgagcgccgtccgcgacgggctcaaccggattccgtacatctacacggtgtgccggcaggagagcaccgccctgggggacgcccctaagcggagcgtcatcgtgctgtctgagttcgtgggatgctcgccgtcgctcagcggggcgatccgggtgaacccatggagcgtggagtccgtcgccgaggccatgagctcggcattgaggatgtccgacggcgagcagcggctgcggcacgagaagcattacaagtatgtgagcacccatgatgtggcctactgggcgcgctcgttcgaccaggacctgcagcgagcctgcaaggaccatttctcgcgccggcattgggggattggtttcgggatgagcttcaaggtggtggcgctcggcccaaatttcaggcggctttccgtcgagcacattgtgccgtcgttcagaaagacggagaaccggctgattctcctggactacgatgggaccgtgatgccggagagctccatcgacaaggcgccgagcagtgaggtcatctccgtcttgaatcgtctgtgcgaagacccgaagaacagggtgttcatcgtgagcggtcgggggaaggatgagctgagcaagtggttcgcgccatgtgagaagctggggattgctgcagagcacggctacttcactaggtggagcaaggaatcgccatgggagacctgcgggctggtggcggacttcgactggaagaagaccgccgagccggtgatgagactgtacacggaggccaccgacggatcgtacatcgagcacaaggagagcgcgctggtgtggcaccacgacgaggccgatccggacttcggttcgtgccaggcgaaggagctgctcgaccatctcgagagcgtgctcgccaacgagccggtcgtggtgaagaggggccagcacatcgtggaggttaacccccagggcatcagcaagggcgtggtggtggagagcctcctgtcgtccatggtgcgcggcggcaaggcccccgacttcgtgctctgcatcggggacgaccggtccgacgaggacatgttcgagagcatcgtgtgcccggccaacggcagcgtgaagctcccggcgacgagcgaggtgtttgcgtgcaccgtggggaagaagccgagcatggccaagtactacctggacgacacggtggacgtgatcaagatgctgcaggggctggcgagcgcgccgtcgcagcaccggccgtggcccgtgcagctccgggtcaccttcgaggaaggaaacggggtatgaataagccgccgacgatgatgtcaataacccatgaaaaaaagaaggatgatgacgacgatgatgatgatgattcggtcaatcagttggtgtggttttaggattagctgcagttagaggataaacaggtttctttcttctttcttcttcttcttattcttcttctggtttacgtttaaaacctcttcctctcgcgcacgcttatacatatgcccgccccatacattgagcgtgagaggaagaggtttgttccttccggtcacattgtatatgtagttgacgatgacgatgaaatcaatccgag

SEQ ID NO: 375 - DNA, 3171 bp, Secale cereale
cggcaagcccccatccacctcaccaccgcattcccacgcggccctccccgtcgcttcatgcgccattcccgtccagctctgggcatccgcggcgccggcgcataggtaggacggacgatgccgtcgctctcctgccacaacctgctcgacctggccgacgagctcccgccgctgcccccctcccgctccgcctcccgcgggtcatggccgccgcctccccctcctcgccggcctcgccggccccgcagggcccgccgcggcgggtcatcgtctcccaccgcctgcccctccgcgcctcccccgaccccgccgcgcccttcgggtttagattcaccgtcgacgcgggcaccgtcgcctaccagctccgctcgggcctcccgcccgcggcccccgtgctgcacgtcggcacgctcccgcccgccgcggcggaggccgcctccgacgagctggccgctacctgatggcgaatttctcgtgcctccccgtcttcctccccgccgacctccacggcaagttctaccacggcttctgcaagcactacatgtggccgctcctccactacctgctcccgctcacgccctccacgctcggcggcctgccgttcgaccgcgcgctctaccactccttcctctccgccaaccgcgccttcgccgaccgcctcaccgaggtgctcgcccccgacgacgacttcgtctggatccaggactaccacctcctcgccctccccaccttcctccgcaagcgcttcccgcgcgcccgggtcggcttcttcctccactcgcccttcccctcctcggagatcttccgcaccatccccgtccgcgacgacctgctccgcgccctcctcaacgccgacctcgtcggattccacaccttcgactacgcgcgccacttcctctccgcctgctcccgcctcctcggcctcgactaccagtccaagcgcgggtacatcggcatcgagtactacggccgcaccgtcaccgtcaagatactgcccgtcggcatcgacatgggccagctccgctccgtcgtgtcggcgccggagacggccgacgtggtgcgccaggtcgccgacgcctacaaggggcggcgcctcatgctgggcgtggacgacgtcgatctcttcaaggggatcgggctcaagtttctggggatggagcagctgctggtggagaaccccgagctccgcggcaaggccgtgctcgtgcagatcaccaacccggcgcgcagcgagggccgggacgtgcaggaggtgcaggacgaggccagagccatcagcgctcgggtcaatgagcggttcggcacccccgggtacaccccgatcgtgatgatcagccgcccggtgtcggagcacgagaaggcggcctactacgccgccgcagagtgctgcgtggtgagcgccgtccgcgacggactcaaccggattccgtacatctacacggtgtgccggcaggagagcacggcactgggcgacgcccctaacgcgaagcgtcatcgtgctgtctgagttcgtgggatgctccccgtcgctcagcggggcgatccgggtgaacccatggagcgtggagtccgtcgcggaggccatgagctcggcattgaggatgtctgacggcgagcagcggctgcgccacgagaagcattacaagtatgtgagcacccatgatgtggcctactgggcgcggtccttcgaccaggacctgcagcgagcctgcaaggaccatttctcgcggcggcattgggggattggatttgggatgagcttcaaggtggttgcccttggcccaaatttcaggcggctttctgtcgagcacattgtgccgtcgttcaggaagacggagaaccggctgattctcctggactacgatgggaccgtgatgccagagagctccatcgacaaggcaccgagcagcgaggtcatctccgtcttgaatcgtctgtgcgaagatccgaagaacagggtgttcatcgtgagcggtcgggggaaggatgagctgagcaagtggttttcgccatgtgagaagctggggattgctgcggagcatggctacttcactaggtggagcaaggaatcgccatgggagacctgcgggctggtggccgacttcgattggaagaagaccgccgagccggtgatgagactctacacagaggcgacggatggatcatacatcgagcacaaggagagcgcgctggtgtggcaccacgacgaggcggatccggacttcggctcatgccaggcgaaggagctgctcgaccatctcgagagcgtgctcgccaacgagccggtcgtcgtgaagaggggccagcacatcgtggaggttaacccccagggcatcagcaagggcgtggtggtggagagcctcctgtcgtccatggtgcgcggcggcaaggcgcccgactttgtgctctgcatcggggacgaccggtcggacgaggacatgttcgagagcatcgtgtgcccggccaacggccgcgtgaagctcccggcgacgagcgaggtgttcgcgtgcaccgtggggaagaagccgagcatggccaagtactacctggacgacacggtggacgtgatcaagatgctgcaggggctggccaacgcgccgtcgcagcagcggccgtggcccgtgcagctccgggtcaccttcgaggaagggaatggagtatgaaaacagaccaaccacatgtcaataaccaccaatgaaaaaaaggaaccatgatgatgattcggcaagtcggtcggtgtggttttaattaggattagctgcagtttacaggataaacaggtttctttcttctttcttcctttctgatttacgtttccaacctcttctctcacgcacgcatatacatatgcccgccccatacattgagtgagaagaagaggtctgttccggtcggtcacattgtatatgtagttgacgatgacgatgaaatcaatcagagcagaaaggtctgttccggtcggtcacattggtatatgtagttgacgattcgacgatgaaatcaatcaatgtatggggcgggcatagtggtataatgccgtgcggtagaggagaaccaggtttctttcttcttcgttttcttcccttttctggggttttaaacgtttccaaaccttccttcgagtcggttgggaaggcaaagggcacccaggggtatgggcccccccccccc

SEQ ID NO: 376 - DNA, 2979 bp, Secale cereale
gactatccccagaagcttccacaagcggcaagcccccatccacctcaccaccgtcctccccacgcggccctccccgtcgcttcatgcgccattcccgtccagctctgggcatccgcggcgccggcgcataggtaggacggacgatgccgtcgctctcctgccacaacctgctcgacctggccgacgagctcccgccgctgcccccctccccgctccgcctcccgcgggtcatggccgccgcctccccctcctcgccggcctcgcccgccccgcagggcccgccgcggcgggtcatcgtctcccaccgcctgcccctccgcgcctcccccgaccccgccgcgcccttcgggtttaaattcaccgtcgacgcgggcaccgtcgcctaccagctccgctcgggcctcccgcccgcggcccccgtgctgcacgtcggcacgctcccgcccgccgcggcggaggccgcctccgacgagctggccgcctacctgatggcgaatttctcgtgcctccccgtcttcctccccgccgacctccacggcaagttctaccacggcttctgcaagcactacatgtggccgctcctccactacctgctcccgctcacgccctccacgctcggcggcctgccgttcgaccgcgcgctctaccactccttcctctccgccaaccgcgccttcgccgaccgcctcaccgaggtgctcgcccccgacgacgacttcgtctggatccaggactaccacctcctcgccctccccaccttcctccgcaagcgcttcccgcgcgccagggtcggcttcttcctccactcccccttcccctcctccgagatcttccgcaccatccccgtccgcgacgacctcctccgcgccctcctcaacgccgacctcgtcggcttccacaccttcgactacgcgcgccacttcctctccgcctgctcccgcctcctcggcctcgactaccagtccaagcgcggatacatcggcatcgagtactacggccgcaccgtcaccgtcaagatactgccggtcggcatcgacatgggccagctccgctccgtcgtgtcggcgccggagacggccgacgtggtgcgccaggtcgccgacgcctacaaggggcggcgcctcatgcttggcgtggacgacgtcgatctcttcaaggggatcgggctcaagtttctggggatggagcagctgctggtggagaaccccgagctccgcggcaaggccgtgctcgtgcagatcaccaacccggcgcgcagcgagggccgggacgtgcaggaggtgcaggacgaggccagagccatcagcgcccgggtcaatgagaggttcggcacccctgggtacaccccgatcgtgatgatcagccgcccggtgtcggagcacgagaaggcggcctactacgcggccgccgagtgctgcgtggtgagcgccgtccgtgacgggctcaaccggattccgtacatctacacggtgtgccggcaggagagcacggcactgggcgacgcccctaagcgaagcgtcatcgtgctgtctgagttcgtgggatgctccccgtcgctcagcggggcgatccgggtgaacccatggagcgtggagtccgtcgcggaggccatgagctcggcattgaggatgtctgacggcgagcagcggctgcgccacgagaagcattacaagtatgtgagcacccatgatgtggcctactgggcgcggtccttcgaccaggacctgcagcgagcctgcaaggaccatttctcgcggcggcattgggggattggatttgggatgagcttcaaggtggttgcccttggcccaaatttcaggcggctttctgtcgagcacattgtgccgtccttcaggaagacggagaaccggctgattctcctggactacgatgggaccgtgatgcctgagagctccatagacaaggcaccgagcagcgaggtcatctccgtcttgaatcgtctgtgcgaagatccgaagaacagggtgttcatcgtgagcggtcgggggaaggatgagctgagcaagtggttttcgccatgtgagaagctggggattgctgcggagcatggctacttcactaggtggagcaaggaatcgccatgggagacctgcgggctggtggccgacttcgattggaagaagaccgccgagccggtgatgagactctacacagaggcgacggatggatcatacatcgagcacaaggagagcgcgctggtgtggcaccacgacgaggcggatccggacttcggctcatgccaggcgaaggagctgctcgaccatctcgagagcgtgcttgccaatgagccggtcgtcgtcaagaggggccagcacatcgtggaggttaacccccagggcatcagcaagggcgtggtggtggagagcctcctgtcgtccatggtgcgcggcggcaaggcgccggactttgtgctctgcatcggggacgaccggtcggacgaggacatgttcgagagcatcgtgtgcccggccaacggccgcgtgaagctcccggcgacgagcgaggtgtttgcgtgcaccgtggggaagaagccgagcatggccaagtactacctggacgacacggtggacgtgatcaagatgctgcaggggctcgccaacgcgctgtcgcagcagcggccgtggcccgtgcagctccgggtcaccttcgaggaagggaatggcgtatgaaacagaccaaccacatgtcaataaccaccaatgaaaaaaaggaacgatgatgatgatgatgattcggcaagtcggtcgctgtggttttaattaggattagctgcagtttacaggataaacaggtttctttcttcttctttcttccttttctggtttacgtttccaacctcttctctcacgcacgcatatacatatgcccgccccatacattgagtgagaagaagaggtctgttccggtcggtcacattgtatatgtagttgacgatgacgatgaaatcaatcagagcaa

SEQ ID NO: 377 - DNA, 2881 bp, Secale cereale
cttatccccagaagcttccacaagcggcaagcccccatccacctcaccaccgtcctccccacgcggccctccccgtcgcttcatgcgccattcccgtccagctctgggcatccgcggcgccggcgcataggtaggacggacgatgccgtcgctctcctgccacaacctgctcgacctggccgacgagctcccgccgctgcccccctcccgctccgcctcccgcgggtcatggccgccgcctccccctcctcgccggcctcgcccgccccgcagggcccgccgcggcgggtcatcgtctcccaccgcctgcccctccgcgcctcccccgacccgccgcgcccttcgggtttaaattcaccgtcgacgcgggcaccgtcgcctaccagctccgctcgggcctcccgcccgcggcccccgtgctgcacgtcggcacgctcccgcccgccgcggcggaggccgcctccgacgacctggccgcctacctgatggcgaatttctcgtgcctccccgtcttcctccccgccgacctccacggcaagttctaccacggcttctgcaagcactacatgtggccgctgctccactacctgctcccgctcacgccctccacgctcggggggctgccgttcgaccgcgcgctctaccactccttcctctccgccaaccgcgccttcgccgaccgcctcaccgaggtgctcgcccccgacgacgacttcgtctggatccaggactaccacctcctcgccctccccaccttcctccgcaagcgcttcccgcgcgcccgggtcggcttcttcctccactcgcccttcccctcctcggagatcttccgcaccatccccgtccgcgacgacctgctccgcgccctcctcaacgccgacctcgtcggattccacaccttcgactacgcgcgccacttcctctccgcctgctcccgcctcctcggcctcgactcaaatccaagcgcgatacatcggcatcgagtactacggccgcaccgtcaccgtcaagatactgcccgtcggcatcgacatgggccagctccgctcggtcgtgtcggcgccggagacggccgacgtggtgcgccaggtcgccgacgcctacaaggggcggcgcctcatgctcggcgtggacgacgtcgatctcttcaaggggatcgggctcaagttcctggggatggagcagctgctggtggagaaccccgagctccgcggcaaggccgtgctcgtgcagatcaccaacccggcgcgcagcgagggccgggacgtgcaggaggtgcaggacgaggccagagccatcagcgctcgggtcaatgagcggttcggcacccccgggtacaccccgatcgtgatgatcagccgcccggtgtcggagcacgagaaggcggcctactacgccgccgcagagtgctgcgtggtgagcgccgtccgcgacggactcaaccggattccgtacatctacacggtgtgccggcaggagagcacggcactgggcgacgcccctaagagaagcgtcatcgtgctgtctgagttcgtgggatgctccccgtcgctcagcggggcgatccgggtgaacccatggagcgtggagtccgtggcggaggccatgagctcggcattgaggatgtctgacggcgagcagcggctgcgccacgagaagcattacaagtatgtgagcacccatgatgtggcctactgggcgcgctccttcgaccaggacctgcagcgagcctgcaaggaccatttctcgcggcggcattgggggattggctttgggatgagcttcaaggtcgttgcccttggcccaaatttcaggcggctttctgtcgagcacattgtgccgtcgttcaggaagacggagaaccggctgattctcctggactacgatgggaccgtgatgccagagagctccatcgacaaggcaccgagcagcgaggtcatctccgtcttgaatcgtctgtgcgaagatccgaagaacagggtgttcatcgtgagcggtcgggggaaggatgagctgagcaagtggttcgcgccatgtgagaagctggggattgctgcggagcatggctacttcactaggtggagcaaggaatcgccatgggagacctgcgggctggtggccgacttcgattggaagaagaccgccgagccggtgatgagactctacacagaggcgacggatggatcatacatcgagcacaaggagagcgcgctggtgtggcaccacgacgaggcggatccggacttcggctcatgccaggcgaaggagctgctcgaccatctcgagagcgtgctcgccaacgagccggtcgtcgtgaagaggggccagcacatcgtggaggttaacccccagggcatcagcaagggcgtggtggtggagagcctcctgtcgtccatggtgcgcggcggcaaggcgccggactttgtgctctgcatcggggacgaccggtcggacgaggacatgttcgagagcatcgtgtgcccggccaacggccgcgtgaagctcccggcgacgagcgaggtgttcgcgtgcaccgtggggaagaagcccagcatggccaagtactacctggacgacacggtggacgtgatcaagatgctgcaggggctcgccaacgcgccgtcgcagcagcggccgtggccggtgcagctccgggtcaccttcgaggaagggaatggagtatgaaacagaccaaccacatgtcaataaccaccaatgaaaaaaggaaccatgatgatgatgatgatgatgattcggcaagtcggtcggtgtggttttaattaggattagctgcagtttacaggataaacaggtttctttcttcttctttcttccttttctgtttacgtttccaacctcttctctcacgcacgcacgcacg

SEQ ID NO: 378 - DNA, 2654 bp, Secale cereale
gactatccccagaagcttccacaagcggcaagcccccatccacctcaccaccgcattcccacgcggccctccccgtcgcttcatgcgccattcccgtccagctctgggcatccgcggcgccggcgcataggtaggacggacgatgccgtcgctctcctgccacaacctgctcgacctggccgacgagctcccgccgctgcccccctccccgctccgcctcccgcgggtcatggccgccgcctccccctcctcgccggcctcgcccgccccgcagggcccgccgcggcgggtcatcgtctcccaccgcctgcccctccgcgcctcccccgaccccgccgcgcccttcgggtttagattcaccgtcgacgcgggcaccgtcgcctaccagctccgctcgggcctcccgcccgcggcccccgtgctgcacgtcggcacgctcccgcccgccgcggcggaggccgcctccgacgacctggccgcctacctgatggcgaatttctcgtgcctccccgtcttcctccccgccgacctccacggcaagttctaccacggcttctgcaagcactacatgtggccgctcctccactacctgctcccgctcacgccctccacgctcggcggcctgccgttcgaccgcgcgctctaccactccttcctctccgccaaccgcgccttcgccgaccgcctcaccgaggtgctcgcccccgacgacgacttcgtctggatccaggactaccacctcctcgccctccccaccttcctccgcaagcgcttcccgcgcgcccgggtcggcttcttcctccactcccccttcccctcctcggagatcttccgcaccatccccgtccgcgatgacctgctccgcgccctcctcaacgccgacctcgtcggattccacaccttcgactacgcgcgccacttcctctccgcctgctcccgcctcctcggcctcgactaccagtccaagcgcgggtacatcggcatcgagtactacggccgcaccgtcaccgtcaagatactgcccgtcggcatcgacatgggccagctccgctccgtcgtgtcggcgccggagacggcggacgtggtgcgccaggtcgctgacgcctacaaggggcggcgcctcatgctgggcgtcgacgacgtcgatctcttcaaggggatcgggctcaagttcctggggatggagcagctgctggtggagaaccccgagctccgcggcaaggccgtgctcgtgcagatcaccaacccggcgcgcagcgagggccgggacgtgcaggaggtgcaggacgaggccagagccatcagcgcccgggtcaatgagaggttcggcacccctgggtacaccccgatcgtgatgatcagccgcccggtgtcggagcacgagaaggcggcctactacgcggccgccgagtgctgcgtggtgagcgccgtccgtgacgggctcaaccggattccgtacatctacacggtgtgccggcaggagagcacggcactgggcgacgcccctaagcgaagcgtcatcgtgctgtctgagttcgtgggatgctccccgtcgctcagcggggcgatccgggtgaacccatggagcgtggagtccgtcgcggaggccatgagctcggcattgaggatgtctgacggcgagcagcggctgcgccacgagaagcattacaagtatgtgagcacccatgatgtggcctactgggcgcgctccttcgaccaggacctgcagcgagcctgcaaggaccatttctcgcggcggcattgggggattggttttgggatgagcttcaaggtggttgcccttggcccaaatttcaggcggctttctgtcgagcacattgtgccgtccttcaggaagacggagaaccggctgattctcctggactacgatgggaccgtgatgccagagagctccatcgacaaggcaccgagcagcgaggtcatctccgtcttgaatcgtctgtgcgaagatccgaagaacagggtgttcatcgtgagcggtcgggggaaggatgagctgagcaagtggttttcgccatgtgagaagctggggattgctgcggagcatggctacttcactaggtggagcaaggaatcgccatgggagacctgcgggctggtggccgacttcgattggaagaagaccgccgagccggtgatgagactctacacagaggcgacggatggatcgtacatcgagcacaaggagagcgcgctggtgtggcaccacgacgaggcggatccggacttcggctcatgccaggcgaaggagctgctcgaccatctcgagagcgtgctcgccaacgagccggtcgtcgtgaagaggggccagcacatcgtggaggttaacccccagggcatcagcaagggcgtggtggtggagagcctcctgtcgtccatggtgcgcggcggcaaggcgcccgactttgtgctctgcatcggggacgaccggtcggacgaggacatgttcgagagtatcgtgtgcccggccaatggccgcgtgaagctcccggcgacgagcgaggtgtttgcgtgcaccgtggggaagaagccgagcatggccaagtactacctggacgacacggtggacgtgatcaagatgctgcaggggctcgccaacgcgccgtcgcagcagcggccgtggcccgtgcagc

SEQ ID NO: 379 - DNA, 3487 bp, Zea mays
taaagatttaatttacaatttttatctgtttttagcgtctaaatagtgaatgtgatgagcaataaaagagattgtttacaccgggatgtatttaatttttttccacaacgggaggggggcacaggcacacgcatatccaggcttgccatatttataccaccacctcacctccctcacgcgcccgagacacacctcggccgttcttatccccagaagcttccgatcgtctcccacacccgaccgcctgccaaacccgacacactcgtcgcggcgcggcgcttctctcctctcctcttcatgcgccatcgccgccgcctccacctctgcgacgcccacagataggcaggaggaggagggggcgatgccttcgatctcctgccacaatctcctcgacctcgccgcggccgacgacgtgcccctgccgtcgcccacgccgctccgcctcccgcgcgtcatgtccgtcgcgtccccggcctcgcccacctcgccgcccgcgcccgccccgccgcgccgcgtcatcgtctcccaccgcctgccgctccgcgcgtcgccggacccggcggcgcccttcgggttcgccttctccgtcgacgccggcaccgtcgcgtaccagctccgctcggggctgcccgccaacgcgcccgtcctccacatcggcaccctcccagccgccgcggccgaagccgcctcagatgagctgtccgactacctgctagccaatttctcgtgcctgccggtgtacctccctaccgacctccaccaccgcttctaccacggattctgcaagcactacctctggccgctcctccattacctcctcccgctgacgccgtcgtcgctcggcggcctgccgttccagcggactctataccactccttcctctcggcgaacagggccttcgccgaccgcctcaccgaggtgctgtgccccgacgaggacctcgtctggatccacgactaccacctcctcgcgctcccgaccttcctccgcaagcgcttcccgcgagccaaggtcggattcttcctccactcacctttcccctcgtcggagatcttccgcaccatccccgtgcgggatgacctcgtccgcgccctcctcaacgccgacctcgtcggcttccacaccttcgactacgcgcggcacttcctgaccgcgtgctcgcggctgctcggactcgactaccagtccaagcgcggctacatcggcatcgagtactacggccgcaccgtcacggtcaagattctccccgtcgggatcgacatgggccagctcagatcggtggtctcggcgccggagacggaggatgcggtgcggcgggtgaccgaggcgtacaaggggcggcgcctcatggtcggcgtcgacgacgtcgatctgttcaaggggatcgggctcaagttcctggcgatggagcagctgctcgtggagcaccgggagctccgcggccacgccgtgctcgtgcagatcgccaaccctgcgcgcagcgaggggcgcgacgtgcagggcgtgcaggacgaggccagggccatcagcgcccgggtcaatgcgcgcttcggcacccccgggtacacgccgatcgtgctcatcgacgccccggtgacgccgcaggagaaggctgcctactacgcggctgccgagtgctgcgtcgtcagcgccgtccgcgacgggctcaaccggatcccctacatctacacggtgtgccggcaggagagcaccgcgctcggagacgactcgcccaagcggagcgtcatcgtgctctcggagttcgtcggttgctccccgtccctgagcggcgcgatccgcgtcaacccgtggagcgtggagtccgtggcggaggccatgaacgccgcgctgcggatgccggaggccgagcagcggctgcggcacgagaagcactacaagtacgtgagcacccacgacgtcgcctactgggcgcggtccttcgactcggacctgcagcgcgcctgcaaggaccatttctcgcgccggcattgggggatcggcttcggcatgagtttcaaggtggtggcccttggcccgaatttccggcgcctctccgtggagcacattgtcccgtcgtatcggaggacggataaccggctgattctcctggactacgacggcaccgtgatgccggagaactccatcgacaggacgccgagcagtgaggtcatctctgtgttgaatcgtctgtgcgaggaccccaagaacagagtgttcatcgtaagcggacgggggaaggacgagctgagcaggtggttcgccccctgcgagaagctgggcatcgccgcggagcacggttacctcacaaggtggagcagggacgcgccatgggatacctccgggttggccgccgacttcgactggaagaagaccgcggagccggtgatgcagctgtacacggaggcaacagatggctcctacatcgagcacaaggagagcgccatcgtgtggcaccaccacgaggcggatccggacttcggttcctgccaggccaaggaactgctcgaccatctcgagaacgtgctggccaacgagcccgtggtggtgaagagaggccagcacatcgtcgaggttaacccccagggcatcagcaaaggcgtggtagtggacagcctcctgtcgtcgatggtgaggacggggaagccgccggacttcgtgctgtgcatcggcgacgaccggtcggacgaggacatgttcgagagcatcgtgtgcccggcctccaacagcggcgtgaagctgccggccagcagcgaggtgttcgcgtgcacggtgggcaagaagccgagcatggccaggtactacctggacgacacggtggacgtggtcaagatgctggacggcctggccagcgcgccgtcgcagcagcggtccaggccggcggtgcagctgcgggtctcgttcgaaggctcgctctgagggggaagaggagaacacacagcgctagtagcagcagtaaacagcaaacatcgagcaaggataaccagtggtgatgaacacaacgagattcagcagacggcgtggtgtaggattgattagctgcagtttacaggatcgacaatttttttttgctttcttctacattgctacccccaaatctttcgtgcctgtatatgcccgcatggtaatatgcaaagaataacgtttcgaccaccaaccaaaccaccattgtacatgtagttgacgatgacgacgagatcagaaaaggagaagtggggaaaatgattctttcactctgcctgcttgcttgccctgttggcagtcccattcagtcacgctttttttccctccatcctgctgcattacacagtcccggcctggtatggataggataggagcctgatccggctctggtgctccttatccacccctatcccctcttgacggcaacaggaacctggccgccagccatgtcaaaaacgaagggaggccaggctgtagcttgcagttcatatcacaaggacatgtttatcgctagcgagctttccg

SEQ ID NO: 380 - DNA, 2755 bp, Secale cereale
ccgccgcctccccctcctcgccggcctcgccggccccgcagggcccgccgcggcgggtcatcgtctcccaccgcctgcccctccgcgcctcccccgaccccgccgcgcccttcgggtttagattcaccgtcgacgcgggcaccgtcgcctaccagctccgctcgggcctcccgcccgcggcccccgtgctgcacgtcggcacgctcccgcccgccgcggcggaggccgcctccgacgagctggccgcctacctgatggcgaatttctcgtgcctccccgtcttcctccccgccgacctccacggcaagttctaccacggcttctgcaagcactacatgtggccgctcctccactacctgctcccgctcacgccctccacgctcggcggcctgccgttcgaccgcgcgctctaccactccttcctctccgccaaccgggccttcgccgaccgcctcaccgaggtgctcgcccccgacgacgacttcgtctggatccaggactaccacctcctcgccctccccaccttcctccgcaagcgcttcccgcgcgccagggtcggcttcttcctccactcgcccttcccctcctcggagatcttccgcaccatccccgtccgcgacgacctgctccgcgccctcctcaacgccgacctcgtcggattccacaccttcgactacgcgcgccacttcctctccgcctgctcccgcctcctcggcctcgactaccagtccaagcgcgggtacatcggcatcgagtactacggccgcaccgtcaccgtcaagatactgcccgtcggcatcgacatgggccagctccgctccgtcgtgtcggcgccggagacggccgacgtggtgcgccaggtcgccgacgcctacaaggggcggcgcctcatgctgggcgtggacgacgtcgatctcttcaaggggatcgggctcaagttcctggggatggagcagctgctggtggagaaccccgagctccgcggcaaggccgtgctcgtgcagatcaccaacccggcgcgcagcgagggccgggacgtgcaggaggtgcaggacgaggccagagccatcagcgcccgggtcaatgagaggttcggcacccctgggtacaccccgatcgtgatgatcagccgcccggtgtcggagcacgagaaggcggcctactacgcggccgccgagtgctgcgtggtgagcgccgtccgtgacgggctcaaccggattccgtacatctacacggtgtgccggcaggagagcacggcactgggcgacgcccctaagcgaagcgtcatcgtgctgtctgagttcgtgggatgctccccgtcgctcagcggggcgatccgggtgaacccatggagcgtggagtccgtcgcggaggccatgagctcggcattgaggatgtctgacggcgagcagcggctgcgccacgagaagcattacaagtatgtgagcacccatgatgtggcctactgggcgcggtccttcgaccaggacctgcagcgagcctgcaaggaccatttctcgcggcggcattgggggattggttttgggatgagcttcaaggtggttgcccttggcccaaatttcaggcggctttctgtcgagcacattgtgccgtcgttcaggaagacggagaaccggctgattctcctggactacgatgggaccgtgatgccagagagctccatcgacaaggcaccgagcagcgaggtcatctccgtcttgaatcgtctgtgcgaagatccgaagaacagggtgttcatcgtgagcggtcgggggaaggatgagctgagcaagtggttttcgccatgtgagaagctggggattgctgcggagcatggctacttcactaggtggagcaaggaatcgccatgggagacctgcgggctggtggccgacttcgactggaagaagaccgccgagccggtgatgagactctacacagaggcgacggatggatcgtacatcgagcacaaggagagcgcgctggtgtggcaccacgacgaggcggatccggacttcggctcatgccaggcgaaggagctgctcgaccatctcgagagcgtgcttgccaatgagccggtcgtcgtcaagaggggccagcacatcgtggaggttaacccccagggcatcagcaagggcgtggtggtggagagcctcctgtcgtccatggtgcgcggcggcaaggcgcccgactttgtgctctgcatcggggacgaccggtcggacgaggacatgttcgagagcatcgtgtgcccggccaacggccgcgtgaagctcccggcgacgagcgaggtgttcgcgtgcaccgtggggaagaagccgagcatggccaagtactacctggacgacacggtggacgtgatcaagatgctgcaggggctggccaacgcgccgtcgcagcagcggccgtggcccgtgcagctccgggtcaccttcgaggaagggaatggagtatgaaaacagaccaaccacatgtcaataaccaccaatgaaaaaaaggaaccatgatgatgatgatgatgattcggcaagtcggtcggtgtggttttaattaggattagctgcagtttacaggataaacaggtttctttcttcttctttcttccttttctggtttacgtttccaacctcttctctcacgcacgcacgcacgcatatacatatgcccgccccccatacattgagtgagaagaagaggtttgttccggtcggtcacattgtatatgtagttgacgatgacgatgaaatcaatcaga

SEQ ID NO: 381 - DNA, 4030 bp, Zea mays
atatgataaaaaatatcaaagaacacatagattggtcccgatatcgagggtaacaagtggtattgtgggtatttttattaaacttgaacttggtaaagtatactttggaatgatctattaatttgttgaatatagagtatagatttagcggattagttaaaatctcaatctgattccgtgtaccaagatctggtcaaacgggcccatgaacccaccgttagccgaccgcgacactgatgcacccaaccatcccacattcccacgtcggggaagagcggggcaatgccgtcatttccgcgggcgaacgttgtggataagactagaggcccaagcccatgcgcccatgccgtcacacctcctactctgacctccgggtcgccccgtccgtgtccgttccttcttcctcgccgctcagacacgcacacgcatatccagcttgccatatttgtaccacctgtcctccttccgtgcccgagacccacctcggcgttcttatccccagaaacttcggcaaaagtgatcgatccgtctcccactcccaccccgaccgaccgaccgccgaacgaacccgacacacctcgtcgcgtcgcggcgcttctcttctcttcatgcgctatcgccgccgtttccacctctgcgacgcccacagataggcaggaggaggacgaggaggcgatgccttcgctctcctgccacaacctcctcgacctcgccgctgccgacgaggtgcccctgccgtcgccgacgccgctccgcctcccgcgcgtcatgtccgtcgcgtccccggcctcgcccacctcgccgtccccgcccgccccgccgcgccgcgtcatcgtctcccaccgtctgccgctccgcgcgtcgccggacccttccgcgcccttcggattcaggttctccgtcgacgccggcaccgtcgcgtaccagctccgctcggggctgcccaccaacgcgcccgtcctccacatcggcaccctcccagcgtccgcggcggaggccgcctcagatgagttgtccaactacctgctggctaatttctcgtgcctgccggtgtaccttcccaccgacctccaccaccgcttctaccacggattctgcaagcactacctctggccgctcctccactacctcctcccgctgacgccgtcctcgctcggtggcctccctttccagcgaacgctctaccactccttcctctcggccaacagggcgttcgccgaccgcctcaccgaggtgctgtcccccgacgaggacctcgtctggatccacgattaccacctcctcgcgctcccgaccttcctccgcaagcgcttcccgcgcgccaaggtcggattcttcctccactcacctttcccctcgtcggagatcttccgtacgatccccgtgcgggatgacctcgtccgcgcactcctcaacgccgacctcgtcggcttccacaccttcgactacgcgcgccacttcctgtccgcgtgctcgcggctgctcggcctcgactaccagtccaagcgcgggtacatcggcatcgagtattacggccgcaccgtgactgtcaagatactccccgttgggatcgacatggggcagctcagatcggtggtctcggcgccggagacggaggacgcggtgcggcgggtgacagaggcgtacaaggggaggcgcctcatggtaggcgtcgacgacgtcgatctgttcaaggggatcgggctcaagttcctggcgatggagcagctgctcgtggagcaccgggagctccgcggccgcgccgtgctggtgcagatcgccaaccctgcccgcagcgaagggcgcgacgtgcaaggcgtgcaggacgaggccagggccatcagcgcccgggtcaatgcgcgcttcggcacccccgggtacacgccgatcgtgctcatcgacggcccggtgacgccgcaggagaaggccgcctactacgcggccgccgagtgctgcgtgctgagcgccgtgcgcgacgggctcaaccggatcccgtacatctatacggtgtgccggcaggagagcaccgcgctcggagacgacgcgcccaagcggagcgccatcgtgctctctgagttcgtcggttgttccccgtccctcagcggcgcgatccgcgtgaacccgtggagcgtggagtccgtggcggaggccatgaacgccgcgctgcggatgccggaggccgagcagcggctgcggcacgagaagcactacaagtacgtgagcacccacgacgtcgcctactgggcgcggtccttcgactcggacctgcagcgcgcctgcaaggaccatttctcgcgccggcattgggggatcgggttcggcatgagcttcaaggtggtggcccttggcccgaacttccggcggctctccgtggagcacattgtcccttcgtatcggaggacggagaaccggctgattctcctggactacgacggcaccgtgatgccggagaattcgatcgaccggacgccgagcagtgaggtcatctctgtgctgaatcgtctgtgcgaggaccccaagaacagagtgttcatcgtgagcgggcgtgggaaggacgagctgagtaggtggttcgccccctgcgagaagctgggcatcgcggcggagcacggttacttcacaaggtggagcagggacgcgccatgggaggcctcagcattggccgccgacctggactggaagaacaccgcggagccggtgatgcggctgtacacggaggcaacggacggctcctacatcgagcacaaggagagcggcatggtctggcaccacgacgaggcggatccggacttcggttcctgccaggccaaggagctgctcgaccatctcgagaacgtgctggccaacgaacccgtggtggtgaagagaggccagcacatcgtggaggtgaacccccagggcatcagcaaaggcgtggtggtggacagcctgctgtcgtccatggtgaggacggggaagccgccggacttcgtgctgtgcatcggcgacgaccggtcggacgaggacatgttcgagagcatcgtgtgcccggcctccagcagcggcggcgtgaggctcccggccagcagcgaggtgttcgcgtgcacggtgggcaagaagccgagcatggccaagtactacctggacgacacggtggacgtggtcaagatgctggacggcctggccagcgcgccgtcgccgccgcgacggcccgggccggcggcggcggtgcagctccgggtctcgttcgaaggctcgctctgagggggggaagggaagtaaaacacacagcgctagcggtaaacagcaaacgtcgagcaaagaaaaataaccagtgatgatgaacaggattcagacaggtgtggcgtaggattagctgcagttacaggatcgacagttttttttttggtttcttcttctacattgctacccccaaaatcgttcgtgcctgtatatatgccgttaatgataatgtgcgaagaatgtttggaccacctttgtatatggtagtagctgacgatgacgatgatatcatcagaaggaagaaaaaaaaaaggaagagaagttgattcattcactccggcttccttcctcggttggcagtctcgttcgttcagtcacgcttttcacctttctgcattatacattccgggttggttctggtgctccttatccaacccctatctatccatcccctatgcggcgcttgatggcaacaggagtcatgctgccatgtccgtctctcgggccgctgcggccgtccttttttttctttctcgtcacccacacccaggccccaggccggcaacagctaagcagcaacagcaggctgtacttgatgtggtacacgcgagacagacgtgatgtcagttaaaggccacagcgcaagcgcgctggcgggtgatgcatcatttcacctcgccggcaagatgactggccaacaggcaaaccgtgtcggtaacggtacttggcactacctccaccactcggtgcaggctttcagagaagaagaaagttaagtgttatttggtttaacagatgtaacgtaaat

SEQ ID NO: 382 - DNA, 1982 bp, Setaria italica
agcaaaatcacccaagaaaccagctcaagtgaccagagctaccagcctcgccgtgcaacgcagcagtgctagcagagccaacgccggagccagcaaccacgcaaccgtagatctcagatcaccatgggttctctcggcggcgccgcgcagagcaagccgcacgccgtgtgcctgccgtaccctgcgcagggccacatcaccccgatgctcaacgtggccaagctgctccacgcccggggcttcgacgtcaccttcgtcaacaccgagtacaaccaggcccgcctcgtccggacccgcggcgccgcggccgtggccggcgtcccgggcttccgcttcgccaccatcccggacggcctacccccgtcggaggacgacgacgtcacgcaggacatcccctccctctgcaagtccaccacggagacctgcctcggccccttccgccgcctcctcgcggccctcaacgaccccgccacgggccacccgcccgtcacctgcgtcgtctccgacgtcgtcatgggcttctccatcgacgccgccaaggagctcggcctcccctacgtccagctctggaccgccagcaccatcagcttcctcggctaccagcactatcgcctcctcatgacccgtggcctcgccccgctcaaagatgtcgagcagctgacgaacggattccttgacacgccggtggaggacgtgccggggctccggaacatgaggttccgggacttcccgagcttcatccgcacgacggacccggacgagttcatggtgcactacgtcctcaaggagacggggcgctcggcgggggcgtcggccgtgatcttcaacacattcgacgagctcgagggcgaggcggtggcggcgatggagtcgctgggcctggcgcgcaaggtgtacacgctgggcccgctcccgctgctggcgcgcgaggacccgcccaccccgcgctcctccatcagcctcagcctgtggaaggagcaggaggagtgcctccggtggctcgacggcagggaccccggcgccgtcgtctacgttaacttcggcagcatcaccgtgatgaccaacgagcagctggtggagttcgcgtgggggcttgccaacagcggccggcagttcctgtggatcatccgccgcgacctcgtcaagggcgacagcgccgtgctgccaccggagttcctcgccgcgacggccgaccgcgggctcatggcgagctggtgcccgcagcaggaggtgctcaaccacccggccgtcggcgcgttcctgacgcacagcggctggaactccacgctggagaccatctgcggcggcgtccccgtcatcagttggcccttcttcgccgaccagcagaccaactgccggtaccagtgcagcgagtggggcgtcggcatggagatcgacagcaacgtccgccgcgacgccgtggcgagcctcatcacggagctcatggagggggagcaggggaaggagatgaggagaaaggctcgggagtggagggacaaggccatcgaggcggccaagcccggcggcgcgtccgaacgcaacttcgacgacctggtccgcgacgtgctcctccccaagaactaggcagcagggcttcaactttctaatgtgtttttgtcagtgtcatttgtaattcttttcgtttggttcggggagtaacaaacaaattagtgtggttgtgcaaactgcaaaccaataatgtacaagccttaaatcgtataactccgagacaaatggctatgcttatcttggtaaatattggcaagttgttcacttggtgcagtttgtctgcatgcactgaatcggactgaaggcacaactaacgggtggtaccaggcgatgtcaagatgctaggagacttgagtgaagtgtcaggatctgaagattacgatacgccttcactgatacggaccggaggttttctgacaccctctctatttattcaacttgtcacatggctgcagattagtccgacaacttgt

SEQ ID NO: 383 - DNA, 1745 bp, Zea mays
atccatcaaagtcacagagacgaccagctgaagcgaacacagagctgctcgccgtgtaacgcagcaggcagcagcacccagaggcggcaggccacacacacagcacacgcagatcttcgatcaccaccatgggttctctcggcagcgccgcgcagcagcagccgcagcaaccgcacgccgtgtgcctgccgtacccagcgcagggccacatcaccccgatgctcaacgtggcgaagctgctgcacgcccggggcttccacgtcaccttcgtcaacaccgagtacaaccaggcgcgcctcgtccggacccgcggggcggcggccgtggccggcctcccgggcttccgcttcgccaccatccccgacggcctgccgccgtcggaggacgacgacgtcacgcaggacatcccctcgctgtgcaagtccaccacggagacctgcctcgggcccttccgccgcctgctcgcggacctcagcgacccgcccgtcacctgcgtcgtctccgacgtcgtcatgggcttctccatcgacgccaccaaggagctcggccttccctacgtccagctctggactgccagcaccatcagcttcctcggctaccgccactaccacctcctcaagagccgtggcctcgctccgctcaaaagtgtggagcagctgacgaacggattccttgacacggcggtggaggacgtgccggggctgcggaacatgaggttccgggacttcccgagcttcatccgctccacggacccggacgagtacatggtgggctacgtcctccaggagacggggcgcacggcgggcgcgtcggccgtgatcctcaacaccttcgacgagctggagggcgaggcggtggcggccatgcgctcgctcggcctggcgcgcaaggtgtacacgctgggcccgctcccgctgctggcgcgcgaggacccgcccaccccgcgctccgccatcagcctcagcctgtggaaggaggaggaggagtgcctgcggtggctcgacggcagggaccccggctccgtcgtctacgtcaacttcggcagcatcaccgtgatgaccagcgagcagctggtggagttcgcgtgggggctggccaacagcggcaggccgttcctgtggatcatccggcgcgacctcgtcaggggcgacaccgccgtgctgccgccggagttcctgtccgagacggccggccgcgggctcatggccacctggtgcccgcagcaggcggtgctggaccacccggccgtggccgcgttcctcacgcacagcggatggaactccacgctggaggccatgtgcggcggcgtcccggtcatcagctggcccttcttcgccgaccagcagaccaactgccgctaccagtgcaacgagtggggcgtcgggatggagatcgacagcaacgtccggcgcgacgccgtggcgagcctcatcgctgagctcatggagggggagcaggggaaggagatgaggagaagggcactggaatggagggacaaggccatcgaggtggccaagcccggaggcacgtctcaccggaatttcgatgacctggttcgcaatgtgctcctgccaaagaactaggcaacttagctctatatttgcagtttgcacggtgcttctgccagtgccgtgtgattttgttcctttgttttggagggagatggacaggtcagtgtcgttgtgtaaacaataaaaatacatgcatacgagcgtccaattgatgatgggcaagtctgaaacaaa

SEQ ID NO: 384 - DNA, 2520 bp, Panicum virgatum
cggtcaacgtacggctcatgctctcccgagatgacgagagacgtgacgatgaccggagcgccgcgcgcgcgcgcctggcctgggctggcgcacccagcaccccgcgtgcgccgacctcgcggctcgcgccagaaggtactcccgccgatttaggcagcgcggcgtggcatggcgcgcctcccggcgacccggccggcgagacgcgtctcgctcgcacgccgcgcacatgggcgaacctcccggatcgtggcgccgacggcgagccggcctaccgcgcccgtgcgccgttgcgcgcgtaccgacctggcgacatcacacgggttccgcaacagatgacgacccgctgctgcctatccttttcttttctttttaataatatgatacccggctgctacgttcttcggaccataggcgccggaacggaagatatcccaatcgcgagacgccgacggccaacctccaccagattccgtaatgctataatcctccatcggcgcctataaattgccccgcccatgctgacccaacccccaccagcaaaatcatcagcaagaacccaagctccagtgtgccgggcaaagccgcagctctagctagctaagctagagcggatccaagcccgagccagcacccgcaccgcagatcaccgatcaccatgggctccctcggcggcggcgcgcagggcgacagcaggccgcacgccgtgtgcctgccgtacccggcgcagggccacatcaccccgatgctcaacgtggccaagctgctccacgcccggggcttccacgtcaccttcgtcaacaccgagtacaaccacgcccgcctcgtccggacccgcggcgccgccgccgtggccggcgtcccgggcttccgcttcgccaccatcccggacggcctgcccccctcggaggacgacgacgtcacgcaggacatcccctcgctctgcaagtccaccactgagacctgcctcggccccttccgccgcctcctcgcggagctcaacgacgaccccgcccacccgcccgtcacctgcgtcgtctccgacgtcgtcatgggcttctccatcgacgccgccaaggagctcggcctcccctacgtccagctctggacggccagcaccatcagcttcctcggctaccaacactaccgcctcctcatgagccggggcctcgccccactcaaagatgccgagcagctgacgaacgggttcctggacacggcggtggacgacgtcccggggctgcggagcatgaggttccgggacttcccgagcttcatccgcacgacggacccggacgagttcatggtgcactacgtcctcaaggagacggggcgctcggcgggcgcgtcggcggtgatcgtcaacaccttcggcgagctcgagggcgaggcggtggcggccatggagtcgctgggcctggcgcgcaaggtctacacgctgggcccgctcccgctgctggcgcgcgaggacccgcccaccccgcgctcctccatcagcctcagcctctggaaggagcaggcggagtgcctgcggtggctcgacggcagggagcccggcgccgtcgtctacgtcaacttcggcagcatcaccgtcatgaccaacgagcagctggtggagttcgcgtgggggctggccaacagcggccgccagttcctgtggatcatccgccgcgacctcgtcaagggcgacagcgccgtgctgccgccggagttcctcgccgccacggccgaccgcgggctcatggcgagctggtgcccgcagcaggaggtgctggaccacccggccgtcggcgcgttcctcacgcacagcggctggaactccaccctagaggccatgtgcggcggcgtccccgtcatcagctggcccttcttcgccgaccagcagaccaactgccggtaccagtgcaacgagtggggcgtcggcatggagatcgacgccaacgtccgccgcgacgccgtggcgggcctcatcacggagctcatggagggggagcaggggaaggagatgaggaggaaggcccgggagtggcgggacaaagcgatcgaggcggccaagcccgggggggcgtctcaccgcaacttggacgagctggtccgcgacgtgctcctgcccaagaactagacagcagcaggctccccacatctgctgcctactctcacccgtgttcggctggtgtgccagggtctagtagttatgttcattttaatttgttcgggggtaacagacaaatcactgttagcgtggtagtgtaaaccaataatgtacaagcctctccgttttgtactggtatattgctgaacatttcgcttggtccactgtatctgcatgcactgaatcgggatgaaagacacggctaacggatggtgccaagagatgtcaagagctgaagatggtactagaggtgaagtgacttgataaagatgtgaggttttcaggcacctactcctactccttttaattttcgctttttattggtggaggattggttggttcgattggaaaattacttgcttgcaagttgc

SEQ ID NO: 385 - DNA, 2064 bp, Zea mays
gcgagacacatttggtgtccacaataatccatgcaagcacaacagtttgtttcagacttgcccatcctcaattggacgctcgtatgcatgtatttttattgtttacacaacgacactgacctgtccatctccctccaaaacaaaggaacaaaatcacacggcactggcagaagcaccgtgcaaactgcaaatatagagctaagttgcctagttctttggcaggagcacattgcgaaccagttcatcgaaattccggtgagacgtgcctccgggcttggccacctcgatggccttgtccctccattccagtgcccttctcctcatctccttcccctgctccccctccatgagctcagcgatgaggctcgccacggcgtcgcgccggacgttgctgtcgatctccatcccgacgccccactcgttgcactggtagcggcagttggtctgctggtcggcgaagaagggccagctgatgaccgggacgccgccgcacatggcctccagcgtggagttccatccgctgtgcgtgaggaacgcggccacggccgggtggtccagcaccgcctgctgcgggcaccaggtggccatgagcccgcggccggccgtctcggacaggaactccggcggcagcacggcggtgtcgcccctgacgaggtcgcgccggatgatccacaggaacggcctgccgctgttggccagcccccacgcgaactccaccagctgctcgctggtcatcacggtgatgctgccgaagttgacgtagacgacggagccggggtccctgccgtcgagccaccgcaggcactcctcctcctccttccacaggctgaggctgatggcggagcgcggggtgggcgggtcctcgcgcgccagcagcgggagcgggcccagcgtgtacaccttgcgcgccaggccgagcgagcgcatggccgccaccgcctcgccctccagctcgtcgaaggtgttgaggatcacggccgacgcgcccgccgtgcgccccgtctcctggaggacgtagcccaccatgtactcgtccgggtccgtggagcggatgaagctcgggaagtcccggaacctcatgttccgcagccccggcacgtcctccaccgccgtgtcaaggaatccgttcgtcagctgctccacacctgcgcatcacacgaactaacttttgagcggagcgaggccacggctcttgaggaggtggtagtggcggtagccgaggaagctgatggtgctggcagtccagagctggacgtagggaaggccgagctccttggtggcgtcgatggagaagcccatgacgacgtcggagacgacgcaggtgacgggcgggtcgctgaggtccgcgagcaggcggcggaagggcccgaggcaggtctccgtggtggacttgcacagcgaggggatgtcctgcgtgacgtcgtcgtcctccgacggcggcaggccgtcggggatggtggcgaagcggaagcccgggaggccggccacggccgccgccccgcgggtccggacgaggcgcgcctggttgtactcggtgttgacgaaggtgacgtggaagccccgggcgtgcagcagcttcgccacgttgagcatcggggtgatgtggccctgcgctgggtacggcaggcacacggcgtgcggttgctgcggctgctgctgcgcggcgctgccgagagaacccatggtggtgatcgaagatctgcgtgtgctgtgtgtgtggcctgccgcctctgggtgctgctgcctgctgcgttacacggcgagcagctctgtgttcgcttcagctggtcgtctctgtgactttgatggatggaggttggtcagcatggccggggctatttataggcgtcgttcggatttttgcaataaaccatgtggtgatggtggttagggatggcaattggacccgtgggtatggatacccacgggtttcgtacccgatgaacatggatatgggttgaaaaacttacccgtggattctgtcgggtcgggtacccgaaatacatcgggtagggtacggatagtatattttacccatgggtatccattagatacccgaaatat

SEQ ID NO: 386 - DNA, 2182 bp, Panicum virgatum
ccagccactagccgattaacaatatttttctctcacaccactctaaccacaagctccagctccacgaacagaatgattatatcggcgccaataaatagccccgcccatgctgacccaaccccaccagcaagatcatcaagaagaacccaagctccagtgtgccgggcaacgccgcagcccgcagcgctagctagctagagcggatcaacgcccgagccagcaccccgcacccgcaccccccgcgatcagatcaccgatcaccatgggctccctcggcggcgccgcgcaggccagcagcaggccgcacgccgtgtgcctgccgtacccggcgcagggccacatcaccccgatgctcaacgtggccaagctgctccacgccaagggcttccacgtcaccttcgtcaacaccgagtacaaccacgcccgcctcgtccggacccgcggcgccgccgccgtggccagcgtcccgggcttccgtttcgccaccatcccggacggcctgcccccctcggaggacggcgacgtcacgcaggacatcccctcgctctgcaggtccacaaccgagacctgcctcggccccttccgccgcctcctcgcggagctcaacgacgtccccgccgccgcgggccacccgcccgtcacctgcgtcgtctccgacgtcgtcatgggcttctccatcgacgccgccaaggagctcggcctcccctacgtccagctctggacggccagcgccatcagcttcctcggctaccaacactaccgcctcctcatgagccggggcctcgccccactcaaagatgccgagcagctgacgaacggattcctcgacacgccggtggacgacgtgccggggctgcggagcatgaggttccgggacttcccgagcttcatccgcacaacggacccggacgagttcatggtgcactacgtcctcaaggagacggggcgctcggcgggcgcgtcggcggtgatcatcaacaccttcgacgagctcgagggggaggcggtggcggccatggagtcgctgggcctggcgcgcaaggtctacacgctgggcccgctcccgctgctggcgcgcgaggacccgcccaccccgcgctcctccatccgcctcagcctatggaaggagcaggaggagtgcctgcggtggctcgacggcagggagcccggcgccgtcgtctacgtcaacttcggcagcatcaccgtcatgaccaacgagcagctggtggagttcgcgtgggggctggccaacagcggccgccagttcctgtggatcatccgccgcgacctcgtcaagggcgacagcgccgtgctgccgccggagttcctcgctgccacggccgaccgagggctcatggcgagctggtgcccgcagcaggaggtgctggaccacccggccgtcggtgcgttcctcactcacagcggctggaactccaccctggaggccatgtgcggcggcgtccccgtcatcagctggcccttcttcgccgaccagcagactaactgccggtaccagtgcaaagtgtggggcgtcggcatggagatcgacgccaacgtccgccgcgacgccgtgtcgggcctcatcacggagctcatggagggggagcaggggaaggagatgaggaggaaagccctggagtggagggacaaggcgatcgaggcggccaagcccgggggcgcgtctcgccgcaacttcgacgaactggtccgcgacgtgctcctgcccaagaactagacagcagcaggctcccccaatctgcctctactccgtttctcggtttctgtcagtgtccagtaattttgttcgggggtaacagacaaatggttgtgtaaaccaataatgtacaagccttccatttcgcagctactagtatattgctgaattgttcgcttggtccaccgtatctgcatgcactgaatcggactgaaagacacggccaacagatggtgccaagagatgtgaagaggtccagatggtgctaggggtgaagtgacttgatactgatgcgaggttttcagggacctactcccgcgcctcttacttttcgcttttttttggagaaggattggttggttcgattgggaaattatttgcaagttgcattttgtttagttgcaagtgtacaacttgtatactccaacattctgatgctgaccgttaacggttaacctttgatacaat

SEQ ID NO: 387 - DNA, 1500 bp, Panicum virgatum
cccgagccagcacccgcaccgcagatcaccgatcaccatgggctccctcggcggcggcgcgcagggcgacagcaggccgcacgccgtgtgcctgccgtacccggcgcagggccacatcaccccgatgctcaacgtggccaagctgctccacgcccggggcttccacgtcaccttcgtcaacaccgagtacaaccacgcccgcctcgtccggacccgcggcgccgccgccgtggccggcgtcccgggcttccgcttcgccaccatcccggacggcctgcccccctcggaggacgacgacgtcacgcaggacatcccctcgctctgcaagtccaccactgagacctgcctcggccccttccgccgcctcctcgcggagctcaacgacgaccccgcccacccgcccgtcacctgcgtcgtctccgacgtcgtcatgggcttctccatcgacgccgccaaggagctcggcctcccctacgtccagctctggacggccagcaccatcagcttcctcggctaccaacactaccgcctcctcatgagccggggcctcgccccactcaaaggtaaatcaatcaaccaatcgatcaatgggttcctggacacggcggtggacgacgtcccggggctgcggagcatgaggttccgggacttcccgagcttcatccgcacgacggacccggacgagttcatggtgcactacgtcctcaaggagacggggcgctcggcgggcgcgtcggcggtgatcgtcaacaccttcggcgagctcgagggcgaggcggtggcggccatggagtcgctgggcctggcgcgcaaggtctacacgctgggcccgctcccgctgctggcgcgcgaggacccgcccaccccgcgctcctccatcagcctcagcctctggaaggagcaggcggagtgcctgcggtggctcgacggcagggagcccggcgccgtcgtctacgtcaacttcggcagcatcaccgtcatgaccaacgagcagctggtggagttcgcgtgggggctggccaacagcggccgccagttcctgtggatcatccgccgcgacctcgtcaagggcgacagcgccgtgctgccgccggagttcctcgccgccacggccgaccgcgggctcatggcgagctggtgcccgcagcaggaggtgctggaccacccggccgtcggcgcgttcctcacgcacagcggctggaactccaccctagaggccatgtgcggcggcgtccccgtcatcagctggcccttcttcgccgaccagcagaccaactgccggtaccagtgcaacgagtggggcgtcggcatggagatcgacgccaacgtccgccgcgacgccgtggcgggcctcatcacggagctcatggagggggagcaggggaaggagatgaggaggaaggcccgggagtggcgggacaaagcgatcgaggcggccaagcccgggggggcgtctcaccgcaacttggacgagctggtccgcgacgtgctcctgcccaa

SEQ ID NO: 388 - DNA, 1452 bp, Pennisetum glaucum
ccggggcttcgacgtcaccttcgtcaacaccgagtacaaccaggcccgcctcctccggacccgcggcgccgcggccgtggccggcgtcccgggcttccgcttcgccaccatcccggacggcctgcccccgtcggacgacgacgacgtcacgcaggacatcccttccctctgcaagtccaccacggagacctgcctcggccccttccgccgcctcctcgccgccctcaacgaccccgccaccggccacccgcccgtcacttgcgtcatctccgacgtggtcatggggttctccatcgacgccgcccaggagctcggcctcccctacgtccagctctggaccgccagcgccatcagcttcctcggctaccagcactaccgcctcctcatggcccgtggcctcgctccgctcaaagatgtcgagcagctgacgaacggattcctcgacacgccggtggacgacgtgccggggctccggaacatgaggttccgggacttcccgagcttcatccgcacgacggacccggacgagtacatggtgcactacgtcctcaaggagacggggcgctcggcgggggcgtcggccgtgatcatcaacaccttcgacgagctcgagggcgaggcggtggcggccatggagtcgatcggcatggcgcgcaaggtgtacacgctgggcccgctcccgctgctggcgcgcgaggacccgcccaccccgcgctcctccatcaccctcagcctgtggaaggagcaggaggagtgcctccggtggctcgacggcagggaccccggcgccgtcgtctacgtcaacttcggcagcatcaccgtgatgaccaacgagcagctggtggagttcgcgtgggggcttgccaacagcggcaggcagttcctgtggatcatccggcgcgacctcgtcaagggcgacaccgccgtgctgccgccggagttcctcgccgcgacggccgaccgcgggctcatggcgagctggtgcccgcagcaggaggtgctcaaccacccggccgtcggcgcgttcctgacgcacagcggctggaactccacgctggagaccatctgcggcggcgtccccgtcatcagctggcccttcttcgccgaccagcagaccaactgccggtaccagtgcagcgtgtggggcgtcggcatggagatcgacagcaacgtccgccgcgacgccgtggcgagcctcatcacggagctcatggacggggagcaggggaaggagatgaggaggaaggccagggagtggaggaacaaggccatcgaggcggccaagcccggcggcgcgtcccaccgcaacttcgacgacctggttcgcgacgtgctcctccccaagaactgaactaggctgcaggctccaacttccgactgtgtttctgccagtgtcatttgtaattcttttcgttcggttcagggagtaacagccaaattagtgtggttaac

SEQ ID NO: 389 - DNA, 1733 bp, Oryza sativa
gtacaaactcaccaattcgaccacagtcaccacagatcttcttccttcccgagacgccaggaaacgccgggagaaagcatgggttctctgggagcagcaggtaagccgcacgccgtgtgcatgccgtacccggcgcaggggcacatcaccccgatgctgaacgtggcgaagctgctccacgcccgcggcttcgacgtcacgttcgtgaacaccgagtacaaccacgcccgcctcgtccgcacccgcggcgaggccgcggtggcgggcgcgccgggcttccggttcgccaccatccccgacggcctgccgccgtcggacgacgacgacgtcacgcaggacatcccgtcgctgtgccgctccaccaaggagacctgccttgcccccttccgccgcctcctcgcccagctgaatgaccccgccacgggccacccgcccgtcacctgcgtcgtctccgacgtcgtcatgggtttctccatggctgccgccaaggagctcggcctcccctacgtccagctctggacagccagctccatcagctatctcggataccgtcactaccgcctcctcatggaacgtggccttgccccactcaaagatgtcgatcagctgacgaatggataccttgacacgccggtggaagacgtgccggggctgaggaacatgaggatcaaggacttcccgagcttcatacacacgacgaacccggaggagtacatggtaggctacgtcatcgaggagacggagcgctgcaaggatgcctcggccatcatcgtcaactccttcggcgacctcgagggtgaggcggtggcggccatggaggcgctcggcttgcccaaggtgtacacgctcgggccgctgccgctggtggcgcgcaaggacccgccctcgccgcggcgctcgtccatcaggctcagcctgtggaaggagcaggaggagtgccttcagtggctcgacggcaaggaggctggctccgtcgtgtacgtcaacttcggcagcatcaccgtcatgaccaacgagcagctggtggagttcgcgtgggggctggccaacagcggcagggagttcctgtggatcgtccggcgcgacctcgtcaagggcgacacggccgtgctgccgccggagttcctggccgagacggcggagcgcggcctcatggcgtcctggtgcccgcagcaggacgtgctgaaccaccccgccgtgggcgcgttcctgacgcacagcggctggaactcgacgctggagagcttggccgccggcgtgcccgtcatcagctggccattcttcgccgaccagcagacgaactgccggtaccagtgcaacgagtggggcgtcggcatggagatcgacagcaacgtcaagcgcggcgccgtcgcgtgcctcatcgctgagctcatggaaggtcagaaggggaaggagatgaggaggaaggcggaggagtggagggagaaggcgatcagggcggctaagcccggcggctcgtctcaccgcaacttcgaagagctggtccgccacgtgctcctggccaaagagtcgtagctcctcgcgtatgatttcctttgcgctagtgtcgttgtcatgagtgataagccatgaggtgatcagtgttgtattgtgtatttgtggctactggcctactgcctatatatactggatggtgcaatatcaccctgtttgatttacattgttcagcctattattgtaatggattatctactcattattttgataaattt

SEQ ID NO: 390 - DNA, 1812 bp, Triticum aestivum
ccaagttccaaaacaaagcaagcgcgccgtccacgagagttcagccaggaggaagagcaattgttgccatcgaccgatcttgggtcagctcgaagcacacggagggcaacaagaagtcatctgcggaggagatgggttcgatggggcctgccgccgggaagccgcacgcggtgtgcctgccgtacccggcgcaggggcacatcacgccgatgctcaacgtggccaagctgctccacgcccggggcttcgacgtcaccttcgtcaacaccgagtacaaccacgcccgcctcgtccgctcccgcggccctgccgccgtggccggcctcccgggcttccgcttcgccaccatccccgacggcctgccgccgtctgacgacgacgacgtcacgcaggacatccccgcgctctgcaagtccaccacggagacctgcctcggccccttccgcgacctcctcgcgcggctcaacgaccccgccaccggccacccgcccgtcacctgcgtcgtctcggacgtcgtcatgggcttctccatggaggccgccaacgagctcggcctcccctacgtccagctctggaccgccagcgccatcagctacctcgggtaccgccactaccgcctcctcatcagccgtggcctcgtgccacttaaagacgccgagcagctggcgaatggataccttgacacgccggtggaagaagtgccggggctgaggagcatgaggctcagggacttcccgtccttcatacgcaccacggacccggacgagtacatggtgcactacgtcctcagggagacggagcgcacggctggggcgtcggccgtcatcctcaacagcttcgccgacctggagggcgagtcggtggaggccatggaggcgctcggcctgcccaaggtgtatacgctcggccctctcccgctgctggcgcgcgaggagccgcccacgccgcgctccgccatcaacctcagcctgtggaaggagcaggaggagtgcctgcagtggctggaaggcagggagcccggctccgtcgtgtacgtcaacttcggcagcatcaccgtcatgaccagcgcgcagatggtggagttcgcgtgggggctggcgcagagcgggaagcagttcatgtggatcgtccgccgagacctggtgagaggcgacgccgccgtgctccccgaggagttcctggccgagacggcggggcgcgggctcatggcgtcctggtgcccgcagccggaggtgctggaccaccccgccgtgggcgccttcctaacgcacagcggctggaactcggccctggagagcttgtgcggcggcgtgccagtgatcagctggcctttcttcgccgaccagcagaccaactgcaggtaccagtgcaacgagtggggcgtcggcatggagatcgatagcaacgtccggcgcgatgccgtcgcgggacttatcacggagatcatggaaggggagaaggggaaggggatgaggaagagagcggcgcagtggaaggacagcgcggtcaaggcggccatgcctggcggctcgtctcaccgcaacttcgacgggctggtccgcgacgtgctcctgcccaagaactagctctagatcatcgacatccattgtaactatatagaacaatgtatcttatttgtttgtcaagaaggttcgtttctttcgagagtgatgggccccgagtgatcagcgtagttgtgtagaacgatagagaacaggccacttagtccaattgtactagtaggagtgtaggaccgaagaaacaaatggcgcatggctactcgctgctatatatgacctgattcgttggatt

SEQ ID NO: 391 - DNA, 1861 bp, Lolium multiflorum
gcaagccaaccaagttacacagtgccacaagagtgcagccagagagccaacccttcgttgccattgccatcccatcgatcgatccatcttcatctcgatcggctctgagtctgaacacagggagaaggaattagcttgtcatctccagagatgggatccatgggagcagcggagaagccacacgcggtgtgcctgccgtacccggcgcagggccacatcaccccgatgctcaacgtcgccaagctgctccacgcccggggcttccacgtcaccttcgtcaacaccgagtacaaccaggctcgcctagtccggtcccgtggcccggccgcgctggccggcgtcccgggcttccgcttcgcaaccatccccgacggcctgccgcagtccgacgacgacgacgtcacgcaggacatcccggcgctctgcaagtccaccacggagacctgcctcggccccttccgccgcgttctggccgagctcaacgccgatacggcacaccctcctgttacctgcgtcatctccgacgtcgtcatggggttctccatggaggctgccaaggagctcggcctcacctacgtccagctctggaccgccagcgccatcagctacctcggctaccgccactaccgcctcctcatgaagcgtggcctcgccccactcaaagatgtcgagcagctgacgaacggataccttgacacgccggtggacgacgtgccggggctgaggggcatgcggctgcgggacttcccgaccttcttccgcaccacggacccggacgagtacatggtgcactacgtcctcagagagacggagcgcacggcgggcgcgtcggccgtgatcctcaacagcctcgacgagctggagggcgaggcggtggcggccatggaagcgctcggcctgcccaaggtgtacgcgctcggcccgctcccgctcctggcgcgcgaggacccgcccaccgcgcgctccgccatcaacctcagcctgtggaaggagcaggacgagtgcctggagtggctcgacggcagggcgcccggctccgtcgtgtacgtcaacttcggcagcatcaccgtcatgaccaacgcgcagatggtggagttcgcatggggcctggcgcagagcgggaggcagttcgtgtgggtcgtacgccgggacctcgtcaagggcgacgcggcggtgctgcccgaggagttcctggccgagacggcggggcgcgggctcatgccgtcctggtgcccgcagcaggaggtgctggaccaccccgccgttggggccttcctcacgcacagcggctggaactccaccatggagagcttgtgtggcggcgtgcccgtcatcagctggcccttcttcgccgaccagcagaccaactgcaggtaccagtgccaacagtggggggtcggcatggagatcgacagcaacgtccggcgcgacgccgtcgccgggctcatcacggagatcatggaaggagagaagggcaaggggatgaggaagagggcggtggattggaaggagtgcgctcgcaaggcggccatgcctggcggctcctcccacggcaacttcgacgagctggtccgcgacgtgctcctgcccaagaactagaagatctctccgttgtgattatagaacagtatcttgttcagttgctttgtatgtacttccttcgatccaaataattgattctggattgtctagatacggatgtgtatgtatatgtattttagctctagatatatgcatattttaatgaaattgaatcaattaatttgtatcggatggagtatatcattccacggtggtggattcgaaactgatcagtgttgctgtgtagaactttaaaaaagcggcagatcggagagcacac

SEQ ID NO: 392 - DNA, 1449 bp, Oryza sativa
ctacgactctttggccaggagcacgtggcggaccagctcttcgaagttgcggtgagacgagccgccgggcttagccgccctgatcgccttctccctccactcctccgccttcctcctcatctccttccccttctgaccttccatgagctcagcgatgaggcacgcgacggcgccgcgcttgacgttgctgtcgatctccatgccgacgccccactcgttgcactggtaccggcagttcgtctgctggtcggcgaagaatggccagctgatgacgggcacgccggcggccaagctctccagcgtcgagttccagccgctgtgcgtcaggaacgcgcccacggcggggtggttcagcacgtcctgctgcgggcaccaggacgccatgaggccgcgctccgccgtctcggccaggaactccggcggcagcacggccgtgtcgcccttgacgaggtcgcgccggacgatccacaggaactccctgccgctgttggccagcccccacgcgaactccaccagctgctcgttggtcatgacggtgatgctgccgaagttgacgtacacgacggagccagcctccttgccgtcgagccactgaaggcactcctcctgctccttccacaggctgagcctgatggacgagcgccgcggcgagggcgggtccttgcgcgccaccagcggcagcggcccgagcgtgtacaccttgggcaagccgagcgcctccatggccgccaccgcctcaccctcgaggtcgccgaaggagttgacgatgatggccgaggcatccttgcagcgctccgtctcctcgatgacgtagcctaccatgtactcctccgggttcgtcgtgtgtatgaagctcgggaagtccttgatcctcatgttcctcagccccggcacgtcttccaccggcgtgtcaaggtatccattcagaaattcgtactcacctttgagtggggcaaggccacgttccatgaggaggcggtagtgacggtatccgagatagctgatggagctggctgtccagagctggacgtaggggaggccgagctccttggcggcagccatggagaaacccatgacgacgtcggagacgacgcaggtgacgggcgggtggcccgtggcggggtcattcagctgggcgaggaggcggcggaagggggcaaggcaggtctccttggtggagcggcacagcgacgggatgtcctgcgtgacgtcgtcgtcgtccgacggcggcaggccgtcggggatggtggcgaaccggaagcccggcgcgcccgccaccgcggcctcgccgcgggtgcggacgaggcgggcgtggttgtactcggtgttcacgaacgtgacgtcgaagccgcgggcgtggagcagcttcgccacgttcagcatcggggtgatgtgcccctgcgccgggtacggcatgcacacggcgtgcggcttacctgctgctcccag

SEQ ID NO: 393 - DNA, 1877 bp, Triticum aestivum
aatccatcacaccgatcccagccaaccaaccaagctacgaaacgaagcaagcgccggccgtcgactgatcttgatcgcgtcggagaatatgggttcgatggggcctgccgccgagaagccgcacgcggtgtgcctgccgtacccggcgcagggccacatcaccccgatgctcaacgtcgccaagctgctccacgcccggggcttcgacgtcaccttcgtcaacaccgagtacaaccacgcccgcctcgtccgctcccgcggcctcgccgcggtggccggcctcccgggcttccgcttcgccaccatccccgacggcctgccgccgtccgatgacgacgacgtcacgcaggatatcccggcgctctgcaagtccaccacggagacctgcctcgggcccttccgcagccttctcgcccggctcaacgaccccgccgcggggcaaccgccggtcaactgcgtcgtctccgacgtcgtcatgggcttctccatggaggctgccaacgagctcggcctcacctacgtccagctctggaccgccagcgccatcagctacctcgggtaccgccactaccgcctcctcatcggccgtggcatcgtcccactcaaagatgccgagcagctgacgaacggatacctggacacgccggtggaagacgtgccgggcctgaggagcatgaggctcagggacttcccgtccttcatacgcaccacggacccggacgagtacatagtgcactacgtcctgagggagacggagcgcacggccggcgcgtcggctgtcatcctcaacagcttcgccgacctggagggcgaggcggtggacgccatgaaggcgctcggcctggccaaggtgtacacgctcggccctctcccgctgctggcgcgcgaggagccgcccacgccgcgctccgccatcaacctcagcctgtggaaggagcaggaggagtgcctgcagtggctggaaggcagggagcccggctccgtcgtgtacgtcaacttcggcagcatcaccgtcatgaccagcgcgcagatggtggagttcgcgtgggggctggcgcagagcaggaagcagttcctgtggatcgtccgccgagacctggtgaggggcgacgccgcggtgctccctgaggagttcttggccgagacggtggggcgcgggctcatggcgtcctggtgcccgcagcaagaggtgctggaccaccccgccgtgggcgcctttctgacgcacagcggctggaactcagccctggagagcttgtgcggcggcgtgccggtgatcagctggccattcttcgcggaccagcagaccaactgcaggtaccagtgcaacgagtggggcgtcggcatggagatcaataacaacgtccggcgcgacgccgtcgcggggcttatcacggagatcatggaagggaagaaggggaaggggatgaggaagagagcggcggagtggaaggagagcgcggtcaaggcggccatgcccggcggctcgtctcaccgcaactttgacgggctggtccgcgacgtgctcctgcccaagaattagctctagatcgacgtccattgtaactatagaacacttatcttatttgtttgttaagaaggttcgtttctttcgggagtgatgggccatgagtgatcagtgtggttgtgtagaacgatagagaacatgccacttagtccaattctattactagtaggaggaccgaagaaacaaatggcgcatggctactcgctgctatttatgacccgcgttcgttggattggatcggtggctttacttgtttctttctgacggtatataaaagtgtgtaattcttttatagcggatggtatataaaaatatggttagagcaaggttaatagctcagccggctgct

SEQ ID NO: 394 - DNA, 4509 bp, Setaria italica
ccccaaagccaggcgggcgcgtccaccgtatacacaccgagagccgcgagcaatggacgccgcgggagggagggatggcgaggagaagaaggaagagaagaagggcaacggcggcggcgccgccgccgccgacaagagggtgtcgttcacgggtctgttccggtacgccgacggcacggacgtcctgctgatgctcctcggcacggtgggcgcgctgggcaacggcgtcacgcagcccatcatgacggtcatcttcggccaggtcatcgacggcttcggcggcgccgtcgccctggacgatgtcctccaccgcgtcaacaaggcagttctgaattttgtctacctgggcattgcaacagcggttgtttcctttctccaggtgtcatgctggacgatgacaggagaaaggcaggcaacacgaattagatctctgtaccttaaatctgtcttgagacaagaaatagctttctttgatgtagaaatgacaactgggcaagtagtttcaaggatgtctggtgataccgtgttggttcaggatgccattggtgagaaggtcggcaagttccaacaacttattgctaccttcataggtggctttgtagtagcattcgtaaaaggatggcttttatctcttgtcatgttggcatgcatacctccagtagttctggctggaggaatggtctcaaaaatgctttctaaaatctctagcaaggggcaaacatcatacggtgaagcagggaatgtagtcgaacagacgcttggggccattaaaacagttgtctccttcaacggtgagaagcaggctattgcagcgtacaataaactcatacacaaggcatacaaggcagctgttgaggaaggaattaccaatggttttggcatgggttctgttttctgtatatttttctcaagctatggtttagccatatggtcgttaggtaatgcaacaccctgcatggcagcctttgcagaaggacgatctgcagcatacagattgttcgcaacaatcaagaggaaaccagaaattgaccctgacgacccaagcggcaagcagttagaagacatcaagggtgatgttgacctaaaggatgtgtactttagctacccagcaagaccagatcaactaatatttgatggattctcattacatgtgtctagcggcactacaatggctatagttggggagagtggaagtggcaagtcaactgtcataagtcttgtggagagattctatgatccacaggctggtgaggttttaattgatggcattaacattaagagcttgcggcttgattggataagagggaagatcggtcttgttaaccaagaaccattgctctttatgacatctatcaaagataacatatcatatggcaaagaggatgcaacaattgaagagatcaaaagagcagctgagcttgctaatgcagcaaatttcattgacaaattgcccaacggctatgacacgatggttggccaacgtggcgctcagctctcagggggccaaaagcaaaggattgctattgcaagagcaataattaaagaccccagaattctgttgttagatgaggcgactagtgcattggatgttgagtcagagaggattgttcaggaagcactgaataggatcatggtgaatagaacaacaattgtggttgcacatcgtctgagtactgtgaggaatgccgattgcatatcagttgttcaacaagggaaaatagttgaacaaggaccccatgatgaattgataatgaaccctgatggtgcttattctcaacttattcgtctgcaagaaagccaagaagaagaggaacagaaattagaacgtcgcatgtctgataaaaggtctaaaagtagaagcctctcactgaagcgatcgataggcagaggttctgcaggaaacagcagtcggcattcttcgacggtcccatttggtatgcctggttcagttgagttgctcgaagaaaatgatacaaacggggagaatcagaaagagcaggctgatgatagtgaggccccaaagaaagctcctatgggacggcttgctgctctaaacaagccagaggtaccgattcttttgttaggagcactagctgctggagtgcatggagtgctttttccaatgtttgggctattgatctccaatgccatcaaaactttctatgagccgcctgacaaactaagaaaggattcaagcttttggggtttgatgtgtgttgtgctgggtattgtatcgataatatcagtaccagtggagtttttcttgtttggtgtcgcaggggggaagcttatcgagcgtattcgtgccttgtcatttcggagcattgtgcaccaagaagttgcttggtttgatgatcccaaaaactccagtggagcacttggtgcaaagttgtcagttgatgctctgaatgtccgaagattagtgggtgataacttggccttgttagctcaggtcacctcatcgctaatcactggattggtcattgcttttgtggcagactggaagctcacattgatcatcctttgtgcaatgccactatcgggtgctcaaggatatgcacaagttaagtttttgaagggcttcagtcaagatgccaagatgctgtatgaagatgcaagtcaagtggccactgatgctatcagtagtatcaggactgtagcttctttctgtgctgagaaaagagtcatggcaatctatgatcataaatgtgaagcttcaaagaatcaaggggtcagaacaggaatggttggtggccttggttttggtttctcattcatgatgatgtaccttacatatggcctttgtttctatgttggagggcaattcgtgcgtcataacaaatctacttttgcagacgttttcaaggttttctttgcactgatgctggcaacaattggcatatctcaaacaagtgcattggcttctgattctacaaaggcgaaggattcatctgtctccatatttgctttattggaccgaaagtcgaaagttgactcaagcagtgacgaaggtttgacattagacgaggtcaagggtgacatcgacttcagacatgttagcttcaagtatccaagccgtccagatgttcaaatcttcagtgattttaccctacacataccctccgggaagactgttgcacttgtgggagagagtggcagtggaaaatcaacagtaatttctttgctggaacgattctacaatcctgactctggtaccatctcactagatggggtagaaatcaagagcctaaaggtcgattggctaagggaccaaatagggctggtgggccaagagcctgtgctcttcaacgacacaatccgcgccaacatagcatatgggaagcacggggaggtcactgaggaggagctcctgaaggtcgcaaaggcagccaatgcgcatgagttcatatcaagccttccccaggggtatgacaccactgttggagagaggggggttcagctatctggtggccagaagcagcgggtggccatcgcaagggccatactaaaagatccaaagattcttcttcttgatgaggcaacgagcgccttggatgctgagtctgagcgaattgtgcaagatgccttggacaatgtcatggttggcaggaccacagttattgtggcacaccgcctctcgacgatcaaaagtgctgatattattgcagttctcaaggatggcgtgattgtggagaaaggaagacatgagacgctgatgaacatcaaagatggattctacgcttcgctagttgaacttcgttcagcttcgtcatagtacctaggttaagaattttgttcgcatcactaggcattgtacatcttccttgattcttctctttgtttttatatagttatatggtgtgctacgaatttattgggatataccgatttatttggggtcgctgcgcggctgctaaagacatcatgtggtgggccggtttgccttgtgcattttgaaacgaaacaattggattgtgcacaaggctcgtggtattcaaagatttttcaagtgttgttttaaaatgactgagagttattgtttttcttcaccatttaatcttcctaccagacacaatcttacaacggagccggctaacaaactgcctgagtctcacatcgacggtagcaacgtgccgattgatgtagagtatcatgaagaagaaagcaccgaggcagagccaacagatgaagtggaggatagtgaatgggttccagaagaggatgaagaagaggacagagattttgaactagaggagtgcggagaagaagaggatcacacgaccgcaccagaagaggaggaggaggaggacgacgataactgggacaatgacgaggcaaaagaggatgaggactaccaagcagaagaggaggaggaggatgggcaggatggtgactgggatagtgatgagaccgaagaagatgagaactatcaagcagaagatgaggccaaagaggatgaggatgactatgataaagaagacgatgaagaggaagatgatgacaagccac

SEQ ID NO: 395 - DNA, 4234 bp, Panicum virgatum
gaactaggaagccgccgccccaaaggcaggcgcgcgcacctacacacacacccaacccaaccgcgaggaatggacgccgcggcagctccgggaggcagggatggcgaggagaagaaggaaggagcagagaagaaggggagcggcggcggcgacgccggcgtcaagagggtgtcgttcacggggctgttccggtacgccgacggcacggacgtcctgctgatgctcctcggcacggtgggggcgctggccaacggcgtcacgcagcccatcatgacggtcatcttcggccaggtcatcaacgccttcggtggcgccgtcgccgtggacgacgtcctccaacgcgtcaacaaggcagttctgaattttgtctacctgggcattgcaacagctattgtttcctttctccaggtgtcatgctggacaatgacaggagaaagacaggcaacacgcattcgatctctgtacctcaaatctgtcttgaggcaagaaatagcattctttgatgtagaaatgacaactgggcaaattgtttcaaggatgtctggcgataccgtgttggttcaggatgccattggtgagaaggtcggcaagttccaacaacttattgctacctttgtaggtggctttgtaatagcattcgtaaaaggatggattttatctcttgtcatgttagcttgcatacctcccattgtcgttgctggaggagttgtctcaaaaatgctctctagaatctctagcaaggggcaaacatcatacgacgatgcagggaatgtagttgaacagacgcttgggaacattaaaacagtggtctccttcaatggtgagaagcaggctattgcaacctacaataaactcatacacaaggcatataaggcagctgttgaggaaggaattacaaatggttttggcatgggttctgttttctttatatttttctcaagctatggattagccatatggtgcggcggcaagttgattcttagcagaggttactctggaggagacgtcatcaacattttgtttgctataatgattggggcagcgtctttaggtaatgcaacaccctgcatggcagcctttgcagaaggacaatctgcagcatacagattgttcgcaacaatcaagaggaaaccagaaattgaccctgatgacccaactggtaagcagttagaagacgtcaagggtgatgttgacctaaagaacgtgtacttcagctacccagcaagaccagagcaactaatatttgatggattctcattacatgtgtctagcggcactacaatggctatagttggggagagtggaagtggcaaatcaactgtgataagtcttgtagagagattctatgatccacaggctggtgaggttttaattgatgggattaacattaagagtttgcgacttgattggataagagggaagatcggtcttgttaaccaagagccattgctctttatgacatctatcaaagataatatatcatatggcaacgacgatgcaacaattgaagatatcaaaagagcagctcagcttgctaatgcagcaaatttcattgataaattgcccaacggctatgacacaatggttggccaacgtggtgctcagctctctgggggccaaaagcaaaggatcgctattgcaagagcaataattaaagaccccagaattcttttgttagatgaggcgactagtgcattggatgtggagtcagagcggattgtccaggaagcgcttaataggatcatggtgaataaaacaacactagtggttgcacatcgtctgagtactgtgtggaatgctgattgcatatcagttgttcaacaagggaaaatagtcgaacaaggtccccatgacgaattgataatgaattctgatggtgcttattctcaacttattcgtctgcaagaaagccaagaagaggaagataaaaaattagatcagcgcatgtctgatccaaggtctaaaagtagaagcctctcactgaagcgatcaataagcagaggttctttaggaaacagtagtcgccattctttgtcgctcccatttggtatgcctggttcagttgagttgcttgaaggaaatgatgcaaacagggggaatcagaaagagcaggctgatgatagtgagccccctaagaaagctcctatgggacggctagctggtctaaacaagccagagctaccgattcttttgttaggagcactagcagctggagttcatggaacgctttttccaatgttcggtctaatgctttctaatgccatcaaaactttctatgagtcacctcatgaactaagaaagcattcaagcttttggggttcgatgtgtgttgtgttgggtattatatcgatagtatcagtaccagtggagtatttcttatttggagtagccgggggaaagcttatcgagcgtattcgtgccttgtcatttcggagcattgtgcaccaagaagttgcttggtttgatgatcccaaaaactccagtggagcgcttggtgcaaagttgtcagttgacgctttgaatgtccgacaattagtgggtgataacttggccttgttgactcaggtcacctcaacactaatcactggatttgtcattgcttttgtggcagactggaagctcacattgatcatcctctgtgcaatgccactatcgggtgctcaaggttatgcacaagtaaagttcttgaagggcttcagtcaagatgccaagatgttgtatgaagatgcaaatcaagtggctacggatgcaatcagtagtatcaggactgtagcttctttttgtgctaagaaaagagtcatgacaatctatgatcataaatgtgaagcttcaaagaatcaaggggtcagaacaggaatggttggtggccttggttttggtttctcatacatgatgatgtaccttacatatggtctatgtttctatgttggagggcaattcatacgtcataacaaatctagttttggagacatttttaaggttttctttgcactgatgatggcaacaattggcatatctcaaacaagtgcattggcttctgattctacaaaggcaatggattcatctatctccatatttgctttattggaccgaaagtcaaaaatcgattcaagcagtgatgaaggtttgacattagatgaggtcatgggtgacatcgacttccaacatgttagcttcaagtatccaagccgtccggatgttcaaatcttcagtgattttaccctgcgcgttccctctggaaagactgtagcacttgtcggagagagtggcagtggaaaatcaacagtaatttctttgctggaacgattctacaatcctgactctggtacaatctcattggatggggtagaaatcaagagcctaaaagtcaattggctaagggaccaaatggggctggtgggccaagagcctgtgctcttcaacgacacaatccgcgccaacatagcatacgggaagcatggggagatcattgaggaggagctcatcaaggtcgcaaaagcggccaatgcgcatgagttcatatcaagccttccccaggggtatgacactaccgttggagagagaggggttcagctatccggtggccagaagcagcgagtggccattgcacgggcaatactaaaagatcctaggattcttcttcttgatgaggcaacaagcgccttggatactgagtctgagcgcattgtgcaagatgccttggataatgctgtgattgggaggaccacaattattgtggcacaccgcctctcgacgatcaaaagtgcggatattattgcagttctcaaggatggtgtgatagtggagaaaggaagacatgatacattgatgaacatcgaagatggtttctatgcttcactagttgaacttcgttcagcttcatcgtagtatctaggttaagaattttgttctgatcgctaggcattgtacatcttccttgattcttctctgcatgggcgacgccacagtcatttttcctagtgcaggtgcaccaggatctgagtgaagatttaaagctaattagtggagcaattacttgatgattatagagttgctaggaacatgataaggaggtgcaccggggttctctttcatcttgcctcaccccctgcttctctgtttttatagttcttgtgtgcttatgggtttatagaagaatttcgaggataagcttctctttgcatcactgtaagcatatggttgacattttgaacggtggacttcttgtagatac

SEQ ID NO: 396 - DNA, 4111 bp, Oryza sativa
gagctacgactcaggaatccggcgccgcaggccgaggcgatcgagccgggcgtatctatcttgtacacacagtaaagctgccagcaatggacgcggcggcgaacggcggcagggatggcaaggagaagaaggcgaagaacggcagggacggcgaggacaagaagaaggaggaggacggcgacgccgggaagaaggtgtcgttcacggggctgttccggtacgccgacggcacggacctgctgctgatggcggtcggcacggtggcggcgctcgccaacggggtgtcgcagccgctcatgaccgtcatcttcggccaggtcatcaacgccttcggcgaggccaccaacggcgacgtcctccaccgcgtcaaccaggcggttctcaactttgtctacctgggcatcgcgacagcggttgtttcatttcttcaggtggcgtgctggacaatgactggagaacggcaggcgacacgcattcgatctctatacctcaaatctgtcctgagacaggatatagcattctttgatgtagaaatgacaactgggcagatagtttcaagaatgtccggtgacactgtgttagttcaggatgccattggtgagaaggttggcaagtttctacaacttgtggctaccttcgccggtggtttcgttgtagcatttgtgaaaggttggcttctatcccttgtcatgttggcctgcatccctcctgttgtcattgctggtggagctgtatcgaagatgctagcaaaaatctctagcaagggtcaagcatcatatagcgatgcagcgaatgttgttgaacagacaattggagccataaaaactgttgtttccttcaacggtgaaaagcaggctgttgcatcgtacaataaactcataaacaaggcatacaaggcagctgttgaggaaggacttacgaacggttttggcatgggctccgttttcttcatatttttctccagctatggtttagctatatggtatggcggcaagttggtagtcagcaaaggatactcaggaggagacatcataaatatcttgtttgctgtcatgactggggcaatgtctttagggaatgcgaccccatgtatggcagcctttgcagaagggcaatctgcagcttatagattgttcaaaacaatcaagagaaaaccacagattgatcctgatgacataactgggaaacagttggaggacatcaggggtgatgtggaattgaaggatgtgtacttcagctacccagcaaggcctgagcaactgatatttgatggattttcattgcatgtttctagtggcacgacaatggctatagttggggagagtggaagcggcaagtccactgttattagtcttgtcgaaagattctatgatccacaggctggtgaggttttgattgatgggattaacatcaagagcttgaggcttaattggataagagggaagattggtcttgtcagccaagagccattgctctttatgacctccattaaagataatataacatacggcaaagaggatgcaacaattgaagagattaggagagcagctgagcttgctaatgcagcaaattttattgacaaattacctgatggctatgatacaatggttggtcaacgtggcgcacagctctcagggggacaaaagcaaagaattgctattgctagagcaatacttaaaaaccccaaaatccttctgttagatgaggctactagcgcattggatgtggaatcagagaggatagttcaagaggcactgaacaggatcatggtggacagaaccacacttgtggttgctcatcgcttgaccacagtgaggaatgctgattgtatatcagttgttcaacaaggaaagatagttgagcaaggtccccatgatgaattggtaatgaaccccaatggtgtttattcgcaactcattaggctacaagaaacccacgaagaagaagagaagaaattagaccatcacatatctgattcaaggtctaaaagtagaagtttgtcattcaagcgatcaattagcagggattctgcaggaaatagtagcaggcattctctagcccttccctttggcttgcctggctcagttgaattgcttgaaggcaatgattcgactgtgggggaacagacagagcagggtggtgatggtgaggtccaacagaaagctcctattggacgactggctagactaaacaagccagaggtaccgatacttttgttagcaacactggctgcaggagttcatggagtgcttttcccaatgtttggagtaatgatttccaatgccatcaaaactttctttgagccagcagacaaactaaaaaaggatgctagcttttggggtttgatgtgtgttgtcctgggtataatttcaataatatcaataccggtggagtactttatgtttggaatagctggaggtaaacttgtagagcgtgtccgtgccttgtcattccggagtattattcaccaagaagttgcttggtttgatgatcctaggaattccagtggagcgcttggtgcaagattatcagtagatgctttgaatgtccggcgtttagttggagacaatcttgcattggcagttcaggtcgtctcaacacttatcacaggaattgtcatagcgatgatagcggactggaagctcactttgatcatcctttgtgtgattccacttgtgggtcttcaaggttatgctcaagttaagttcctgaaggggttcagtgaagatgccaagatgttgtatgaagatgcaagtcaagtggctactgatgcagtaagcagcatcaggactgtagcttccttttgttctgagaaaagagtgatgacaatgtatgataataaatgtgaagcttcgaagaatcaaggagttagaacaggaatggttggaggccttggttttggtttctcattcttgatgttgtacctaacatatggtctctgtttctatgtcggagcacaattcgtacgccacaataaaactacttttggggacgttttcaaggttttctttgcactggtgttggcaactattggaatatctcaaacaagtgcgatggcttctgattctacaaaggccaaggattcagctatctccatatttgctttgctagaccgcaagtcacaaattgactcgagtagtgatgagggtaggacattggccaacgtcaagggaaacattgatttccgacatgtcagcttcaagtatccaacccgcccagatgttcagatcttcagtgattttactcttcacataccctctggcaagaccgttgcacttgttggagagagtggtagcggaaagtccacagcaatcgctttgctagagcgattctacaatcccgagtcaggaaccatcttgttggatgaagtagaaatcaagaacttaaaggtcaattggttgagggatcagatggggttggtcggccaagagcctgtgctctttaatgacacaatccgtgctaacatagcctacgggaagcatggggatgtcactgaggaggagctcatcaaagctgcaaaggcatccaatgcacatgagttcatatcgagccttccccaaggatatgataccaccgtgggggagagaggggtgcagctatctggtggccagaaacagcgggtggctattgcgagggccatattgaaagatccaaagatactacttctagatgaggcaacgagtgccttggatgctgaatctgagcgcattgtgcaggatgcgttagataatgtgatggttggcaggactacgattattgtggcgcaccgcctctcgacgatcaaaggtgctgatatcattgcagttctgaaggatggtgcgatagcggagaaaggaaggcatgaggcattgatgaacatcaaagatggtgtctatgcttcacttgttgaactccgttcaggctcatcataatactcaggataagatttttgttttttatttaccctctctggggatgtaatatatcttccttgacccttttttgttttacaattgagggttgtagtagtattaattatttggattttaaagtgggatttgagaaggtgctctctgtatgtatctacgcggtgtcggtttattaagcaacgagaaagaaatattgtcctaca

SEQ ID NO: 397 - DNA, 4549 bp, Aegilops tauschii
aatggagggagcagaacctacgtatttgcgtgatacccctgctttggcaacggtgggatacagttgtatagtagtactcctccgcctttcctcccatttataccctacttactctaagcattgaccagccaaaagcagccagccaccccataaataccccgcgaagtagagccgtaagaatcaggcttaaacaaaagccgtgcgttctcttctgtacacaccaagctgccagcaatggacgccgccgcgaaagggagggacggcgaggagaagaaggagggcgggcacgggaagagggtgtccttcacggggatgttccggtacgccgaccgcacggaccagctgctgatgctggtcggcacgctggccgcgctggccaacggcgtctcgcagccgctcatgacggtcatcttcggcgacatgatcgacgccttcggcggcgccaccagcgacaacgtcctccaccgcgtcaacaaggcggttctgagctttgtctacttgggtatcggaacagcagtggtctcctttctccaggtggcatgctggacaattactggagaaaggcaggccacacgcgttcgatctctatacctcaaatctgtcttgagacaggatatatcattctttgacgtagaaatgacaactgggcagatagtttcaagaatgtctggtgatactgtgctagttcaggatgctattggtgagaaggttggcaagttcttacaacttgtggctactttcataggcggtttcgtggtagcttttgtgaaaggatggcttctatctcttgtcatgttggcatgcatacctccagttgtaattgcaggaggagcagtggcaaaagtgttatctacaatctctagcaaaggtcaagaatcatacagtgatgcagcgaatgttgttgaacagacaattggatccataaaaacagttgcctctttcaatggggagaaacaggccatcggagattacaataaactcataaacaaagcatacaagacaactgtcaaggaaggacttgccaatggttttggcatgggttctgttttcttcatattcttctctagctatggcttagccatatggtacggtggaaagttgatacttaccaaaggatacacaggcggagaagtcatcagtatcttgttcgctatcatgactggggcaatgtctttaggtaatgcaaccccttgtatgacagcctttgcagagggacaatctgcagcacacagattgttcacaacaatcaagaggaaaccagagattgatcctgatgacaagactggtaggcagttagaagatatcaagggtgatgttgagctgagagatgtgtatttcagctacccagcaaggcctgagcaactgatatttgatggattctccttgcatgtgtctagtggcactacaatggctatagttggggagagtggaagtggcaagtcaactgtgattagtcttgtagagagattctatgatccgcaggctggtgaagttttgattgatgggatcaatatcaagagtttacagcttgattcagtaagagggaaaattggtcttgttagccaagagcccttgctctttatgacctcaattaaagataacattacatatggcaaagaaggtgcaacaattgaggagatcaagagagccgctgagctctccaatgcagcaaatttcattgataagttgcccaatggttatgatacaatggttggccaacgcggtgctcagctttcaggggggcaaaagcaaaggatcgcaattgcaagagcaatcattaaaaaccccaaaatacttttgttagatgaagctactagtgcattggatgtggagtcggagaggatagttcaggaggcactgaataggatcatggtggacagaacgacgcttgtagttgctcatcgtctaactactgtcaggaatgctgattgcatatcagttgttcaacaaggaaagatagttgaacaaggtccccacgatgaattggtagtaaacccagatggtgcatactctcaactaattaggcttcaagaacacaatgaagaagagcagaaagtagaccatagaagattggatccgaggtctaaaagtacaagcttgtcattgaagcgatcgattagcagaggttctgcagggaatagtagtaggaattctttcaacctctcctttgggcttcctggcgcagttgaattgcctgaaggaaatgatacacatggggagaatcatacagagcaggatggtgaggttccaaagaaagctcctatgggacggctggcacttcttaataaaccagaggtacttattattctgttaggatccctagctgcagcagttcacggagtgcttttcccaatgttcggcgtgatgatttccagtgccattaaaactttctatgagccaccagataaactcagaaaggattctagcttttggggtttgatgtgtgtggtgctgggtatcatttcgataatctcaatacccgcagagctcttcttgtttggaatagctggagggaagcttatagagcgtatccgtgctatgtcatttcgaagcattgtgcaccaagaagtcgcttggtttgatgatcctaaaaattccagcggagcacttggtgcacgactgtcagttgatgctttgaatgtacggcgtttagtgggagataacttggccttaacggttcagattatctctacacttatcacagggtttgtcattgctatgatagctgactggaagctctctttgatcatcctctgcgtgattccattagtgggccttcaaggttatgcccaagtgaagttcttgaagggtttcagtcaagatgccaagatgatgtatgaagacgcgagtcaagtggccactgatgcaattagtagtattaggaccgtagcttcattttgttctgagaaaagaattacaagaatatatgatgataaatgtgaagcctcaatgagtcaaggagtcagaacaggagtagttggaggcatcggatttggtttctcattcttgatgctgtaccttacgtatggtctttgtttctatgttggagcacaatttgtgcgccatggccaatcaagttttggtgacgttttcaaggttttctttgcactggttttagcaactattggagtatctcaaacaagtgcaatggccaccgattcaacaaaagcaaaagattcagctatttccatatttgctttattggaccgaaagtctgaaatagactcaagccgcaatgagggtttgacattagatgaggtcaagggcaacatcgatttccagcatgtcagcttcaagtacccaacccgcccagatattcagatcttcagtgactttaccctgcacattccctctggcaagactgttgcccttgttggagagagtggtagcggcaagtcaacggtaattggactgttggagcgattctacaatcctgattcaggcaccatctcattggatggagtggaaatcaagagcttaaacatcaattggttgagggaccaaacgggacttgtgagccaagagcctgtactcttcaatgatacaatccgtgccaacatagcctatggtaaggatggggaagttactgaggaggagctaattgcagctgcaaaggcatccaatgcgcatgagttcatatcaagccttccccaaggatatgacaccacagttggggagagggggatacagctgtcgggtggccagaagcagcgggtggcaattgcaagggccatactgaaggaccccaagatactactacttgatgaggcgactagtgccttggatgccgagtccgagcgaattgtgcaggatgcattagacaatgtgatggtcggcaggaccacggttgttgtggctcaccgcctctcgacgatcaaaggtgctgatatcattgcggttctcaaggatggtgcaatagttgagaaaggaaggcacgaggtgctgatgaacataaaagatggtgtgtacgcttcactagtagaacttcgatcagcgtcatcataatacctaggatcagttttggttccgatctctatccacattgtacatcttccctgaccaccttttgttgctgttcctgtaactgtgccgcattattctttggggcttgaagaggaattcgaaaactagaatgaaatttattgtgtctatgtagcgtaagattgtaatcatttagaaggaaatcttgtgcttctgattttgattttgatttttgaaatgtgcattccccccgtcgatatgtaaacgagtgtaatatcctgctgtacataatgcctaacacaaatatttcaagaccgcattgtaaaatgtgggcatgtcctgtataatatgaagactctaccctgtcatcttaagatgctctaggcatcttctgtttagaaattgatcatactgcagttaaatttgtatgagtgtctgacaagaaccaaggcttaccaccgcaccagctgtgtcgttacagtcgggaactccgaacagccgcgcctagcgagatcctgaccggagcctgtcaagccaggacttgggggcggagcagcggacttcctag

SEQ ID NO: 398 - DNA, 4735 bp, Brachypodium distachyon
aagaagcaggctttagaccaaagccgtgcccgtgcgttgtgcgcagacgaaaagccccgagctatagagcgagcaatggacgcagcggcgaaagggagggatggcgaggagcaggccgtggagagcggcgcggagcacgggaagaaggtgtcgttcgcggggctgttccggtacgccgacggcacggacctgctgctgatgctggtgggcaccgtggccgcgctggccaacggcgtgtcgcagccgctcatgacggtcatcttcggcgacgtcatcgacgccttcggcggcgccaccaccgccaacgtcctcagccgcgtcaacaaggccgttctgagctttgtctacttgggtattggaacagcagtagtctcctttcttcaggtgtcatgttggacaattaccggtgaaaggcaggcgacacgcattaggtctctgtatctcaaatctgtcctgagacaagatatatcattctttgatgtagaaatgacaactgggaaaattgtatcaagaatgtcaggtgataccgtgttagttcaggatgctatcggtgagaaggtcggcaagtttctacaacttgtggcttcattcctcggtggatttatagtagcttttgtcaaaggatggcttctagcccttgtcatgttggcatgcataccccctgttgtcattgctggaggagcagtgtcaaaagtgctatcaaaaatctctagcaaaggtcaaacatcatatagtgatgcggggaatgtggttgaacagacaattggagccatcaaaacagttgtttcattcaatggggagaagcaagccattgctacgtacaataaacacatacacaaggcatacaagactgccgtggaggaaggacttaccaatggctttggcatgggttctgttttcttcatatttttctctagctatggtttagctatctggtacggtgggaaattggtacttagcaaaggatacacaggaggtcaggtcatcactatcttgatggctatcatgactggggcaatgtctttaggtaatgcaaccccatgtatgacagcctttgcaggaggacaatctgcagcatataggttgttcacaacaatcaagaggaaaccagagattgatcctgatgacaaaaccggtaagcagttagaagacatcaggggtgaggttgagctaaaggatgtgtatttcagctacccagcaaggcctgagcaactgatatttgatggattctcgttacgtgtggctagtggcactacaatggctatagttggagagagtggaagtggcaagtcaactgtgattagtcttgtagagagattctatgatccacaggccggtgaggttttgattgatgggatcaatatcaagagtttacggcttgattcgataagagggaaaattggtcttgttagccaagagcccttgctctttatgacctcaatcaaagataatataacgtatggcaaagaaaatgcaacaatcgaagagatcaagagagccgctgagctcgccaacgcagcaaatttcattgataagttgcccaatggttacgacacaatggttggccagcgcggtgctcagctttcaggtggacaaaagcaaaggattgcaattacaagagcaatcattaaaaacccaaaaatactattgttagatgaagctactagcgcattggatgtggagtctgagaggatagttcaggaggcattgaacagaatcatggtcgacagaactacccttgtggttgcacatcgtttaactactgtgaggaatgctgattgcatatcagttgttcaacaaggaaaaatagttgaacaaggttcccacgatgaattagtagtaaacccagacggggcttactctcaacttattcggcttcaggaaagtcgtgcagaagaagagcagaaagtagaccgtcgtatatctgatccaaggtctaaaagtacaagcttgtcactgaaggggtcgattagtagaaattcttccggaaatagtagtaggcattctttcaccctcccctttgggctgcctggtacagtcgaattgactgaaaccaatgatacatatgggaagaatcagaatgagcaggataatgattgtgagatcccaaagaaagctcctatgggccggctagcacttcttaacaagccagaggtacctattcttctgttaggatccatagccgcaggagttcatggagtgcttttcccattgtttggtgtgatgatttccagtgccattaaaactttctatgagccaccagagaagctcaaaaaggattctagtttttggggtctgatgtgtgttgtgcttggcgtcgtttcgataatctcaataccagtagaaatgttcttgtttggaatagccggagggaagcttatagagcgcatacgtgcgttgtcgtttcgaagcattatacaccaagaagttgcttggtttgatgatcctaaaaattccagcggagcacttggtgcaagactgtcggttgatgctttgaatgtccggcgtttagtgggagataacttggccttaacagttcagattatttcgacactgatcacaggatttatcattgctgtggttgctgactggaagctctcttttatcatcttgtgtgtgattccgttagtgggtcttcaaggatatgcccaagtgaagttcttgaaaggtttcagtcaagatgctaagatgatgcatgaagacgcaagtcaagtggccacggatgcagtcagtagtatcaggactgtagcttctttttgctcagagaaaagaattacaagcatatacgatcaaaaatgtgaagcctccatgaatcaaggagtcaggacaggaatagttggaggcattggatttggtttctcattcttgatgctgtaccttacatatggcctttgtttctacgttggagcacaatttgtgcgccatggcaaatcaaattttggtgatgttttccaggttttctttgcactggttttagcaactgtgggagtatctcaaacaagtgcaatggccaccgattcaacaaaagcaaaggattcagctatctctatatttgccttgctggaccgtaagtccgaaatcgactcaagcagcaatgagggattgacattagacgaggtgaagggcaacatcgacttccaacatgttagcttcaagtatccaactcgcccagatattcaaatcttcagtgactttaccctgcacattccctccggcaagactgttgcactcgttggagaaagcggtagcggcaaatcaacagtaatcgcactgttggagcgattctacaaccccgattcaggtaccatctcattagatggagtggaaattaagagcttaaatatcaattggttgagggaccaaacaggacttgtgagtcaagagcctgtacttttcaacgacacaatccgtgccaacatagcctatggtaaggatggggaactcacggaggaggagctcattgcagccgcaaaggcatccaatgcacatgagttcatatcaagccttccccaaggatatgacaccaccgttggggaaagggggattcagctatctggtggccagaagcagagagtggctattgcaagggccatactgaaagatcctaagatactactacttgatgaggcaactagcgccttggatgctgagtctgagcgtattgtgcaggctgccttagatcatgtgatggttggcaggaccacggttgttgtggcacaccgcctctcgacgataaaaaatgcagatatcattgcagttctcaaggatggtgcaatagtggaaaaaggaaggcacgaggcgctgatgaacatcaaagatggaatgtacgcttcactagtagaactccgttcatcatcatcatgatatataggataagtttgggttcctaactatatacatgacccctttttgttgctgcgattgtggtatatttattctttaggacttgaagaggaattcgagaagtaaactactgtttcatgtatctatgatgcagtctaagattgtaagtatttagaaagaaatcttctgattttgattttgaagtgcacttccccacgtcgatgtgtaaatgagtgtcaatttctgctgtacaaatacgcctgtgcataataccatataaatgtttgaagatcgtcttgcaaaatgtggactctctactacttttaaagacaccaacttgttcttttcaagatccaagccactaaacgcacacagactactaatagccacacaaacaggcccactaaacacagattagtttctaatcatgtgcgcttagcgattaagccattgaggctgacagtctgcttggcagaggataaggtcgtaccaccgcatcaacccatcgaggctcatataaaaaaactccatcgaggctgactgtctacaaacgagtcgctgccccgcgtggcatccctgcctcgcgtcgcagccccgacccacgcgccctgccgtcgtcgccgcccagccgccgttgcggccctgcacagtcgccgccgtcgcgcctctgcgcctggccgccgccgtcgcagccccggcccgcgtcactgccttcgccccctcccaacacccaatcccacgtttttcgccaactcactgctgccgctgccgtctagggtctccttggccgccgctgtgctgccatcggccgttgcctgtactcctcgacctgcagcgtgacatcaacaggcgcgagcactgccagggcgtcgtgctgttaatctgtgcgcag

SEQ ID NO: 399 - DNA, 4015 bp, Secale cereale
acaaagccgtgcgttctgtacacaccaaagctgccaacaatggacgcggcggccgccgcgaaaggcaaggatggccatggcgaggagaagaaggagggcgggcacgggaagcgggtgtccttcaccgggatgttccggtacgccgaccgcacggacctgctgctgatgctggtcggcacgctggccgcgctgggcaacggcgtctcgcagccgctcatgacgctcatcttcggcgacctcatcgacgccttcggcggcgccaccagcgacaacgtcctccaccgcgtcaacaaggcggttctgagctttgtctacttgggtatcggaacagcagtggtctcctttctccaggtggcatgctggacaatcaccggcgaaaggcaggccacacgcattcgatctctgtatctcaaatctgtcttgagacaggatatatcattctttgacgtagaaatgacaactgggcagatagtttcaagaatgtctggcgacactgtgctagttcaggatgctattggtgagaaggttggcaagttcctacaacttgtggctactttcattggtggtttcgtggtagcttttgtcaaaggatggcttctatctcttgtcatgttggcatgcatacctccagttgtaattgcaggaggagcagtggcaaaagtgttatctacaatctctagcaaaggtcaagcatcatacagtgatgcagcgaatgttgttgaacagacaattggatccataaaaacagttgcctctttcaatggggagaagcaggccatcggagagtataataaactcattaacaaagcatacaagacaactgtcaaggaaggacttgccaatggttttggcatgggttctgttttcttcatattcttctctagctatggtttagccatatggtatggtggaaagctgatacttaccaaaggatacacaggaggagaagtcatcagtatcttgttcgctatcatgactggggcaatgtctttaggtaatgcaaccccttgtatgacagcctttgcagaaggacaatctgcagcacacagattgttcacaacaatcaagaggaaaccagagattgatcctgatgacaagactggtaagaagttagaagatatcaagggtgatgttgagctgagagatgtgtatttcagctacccagcaaggcctgagcaactgatatttgatggattctccttgcatgtgtctagtggcactacaatggctatagtcggggagagtggaagtggcaagtcaactgtgattagtctagtagagagattctatgatccgcaggcgggtgaagttttgattgacgggatcaatatcaagagtttacagcttgattccgtaagagggaaaattggtcttgttagccaagagcccttgctctttatgacctcaattaaagataacattacatatggcaaagaaggcgcaacaattgaggagatcaagagagccgctgagctcgccaatgcagcaaatttcattgataagttgccaaatggttatgatacaatggttggccaacgcggtgctcagctttcaggggggcaaaagcaaaggattgcaattgcaagagcaatcattaaaaaccccaaaatacttttgttggatgaggccactagtgcattggatgtggagtcggagaggatagttcaggaggcactgaataggatcatggtggacagaacgacgcttgtggttgctcatcgtctaactactgtcaggaatgctgattgcatatcagttgttcaacaaggaaagatagttgaacaaggtccccacgatgaattggtagtaaacccagatggtgcatactctcaactaattaggcttcaagaaaacaatgaagaagaccagaaagtagaccatagaagattggatccaaggtctaagagtacaagcttgtcattgaagcgatcgattagcagaggttctgcagggaacagtagtaggaattctttcaacctctcctttgggcttcctggcgcagttgaattgcctgaaggaaatgatacacatggggagaatcatacagagcaggatgttgaggttccaaagaaagctcctatgggacggctggcacttcttaataaaccagaggtacttattattctgttaggatccctagctgcagcagttcacggagtgcttttcccaatgttcggcgtgatgatttccagtgccattaaaactttctatgagccaccagataaactcagaaaggattctagcttttggggtttgatgtgtgtggtgctgggtatcatttcgataatctcaatacccgcagagctcttcttgtttggaatagccggagggaagcttatagagcgtatccgtgctatgtcatttcgaagcattgtgcaccaagaggtcgcttggtttgatgatcctaaaaattccagcggagcacttggtgcaagactgtcagttgatgctttgaatgtacggcgtttagtgggagataacttggccttaacagttcagattatctctacacttatcacagggtttgtcattgctatgatagctgactggaagctctctttgatcatcatctgcgtgattccattagtgggtcttcaaggttatgcccaagtgaagttcttgaagggtttcagtcaagatgccaagatgatgtatgaagacgcaagtcaagtggccactgatgcaattagtagtattaggaccgtagcttcattttgttctgagaaaagaattacaagaatatatgatgataaatgtgaagcctcaatgagtcaaggagtcagaacagggatagttggaggcatcggatttggtttctcattcttgatgctgtaccttacctatggtctttgtttctatgttggagcacaatttgtgcgccatggccaatcaacttttggtgacgttttcaaggttttctttgcactggttttagcaactattggagtatctcaaacaagtgcaatggccaccgattcaacaaaagcaaaagattcagccatttccatatttgctttattggaccgaaagtctgaaatagactcaagccgcaatgagggtttgacattagatgaggtcaagggcaacatcgatttccagcatgtcagcttcaagtacccaacccgcccggatattcagatcttcagtgattttaccctgcacattccctctggcaagactgttgcccttgttggagagagtggtagcggcaagtcaacggtaattggactgttggagcgattctacaatcctgattcaggcaccatctcattggatggagtggaaatcaagagcttaaacatcaactggttgagggaccaaacgggacttgtgagccaagagcctgtactcttcaatgatacaatccgtgccaacatagcctatggtaaggatggggaagttactgaggaggagctcattgcagctgcaaaggcatccaatgcgcatgagttcatatcaagccttccccaaggatatgacaccacagttggggagagggggatacagctgtcgggtggccagaagcagcgggtggcaattgcaagggccatactgaaggaccctaagatactactacttgatgaggcgactagtgccttggatgctgagtccgagcgaattgtgcaggatgcactagaccatgtgatggtcggcaggaccacggttgttgtggctcaccgcctctcgacgatcaaaggtgctgatatcatcgcggttctcaaggatggtgcaatagtcgagaaaggaaggcacgaggtgctgatgaacataaaagatggggtgtacgcttcactagtagaacttcgatcagcggcatcataatacctaggatcagttttggttccgatctctatgcacattgtacatcttccctgaccaccttttgttgctgtttctgtaaccgtgccgcattattctttggggcttgaagaggaattcgagaactagaatgaaatttattgtgtctatgtagcttaagattgtaatcatttagaaggaaatcttgtgcttctga

SEQ ID NO: 400 - DNA, 3890 bp, Panicum virgatum
aggcagttctgaattttgtctacctgggcattgcaacagctgttgtttcctttctccaggtgtcatgctggacaatgacaggagaaagacaggcaacacgcattcgatctctgtacctcaaatctgtcttgaggcaagaaatagcattctttgatgtagaaatgacaactgggcaaattgtttcaaggatgtctggagataccgtgttggttcaggatgccattggtgaaaaggtcggcaagttccaacaacttattgctaccttcataggtggctttgtaatagcattcgtaaaaggatggcttttatctcttgtcatgttggcaagcatacctcccgttgtcgttgctggaggaattgtctcaaaaatgctctctagaatctctagcaaggggcaaacatcatatggcgatgcagggaatgtagttgaacagacgcttggtaacattaagacagtggtctccttcaacggtgagaagcaggctattgcaacctacaataaactcatacacaaggcatataaggcagctgttgaggaaggaattacaaatggttttggcatgggttctgttttctttatatttttctcaagctatggattagccatatggtacggcggcaagttgattcttagcaaaggttactcaggaggagacgtcatcaacatcttgtttgctataatgactggtgcaatgtctttaggtaatgcaacaccctgcatggcagcctttgcagaaggacaatctgcagcatatagattgttcgcgacaatcaaaaggaaaccagaaattgaccctgatgacccaactggtaagcagttagaagacatcaagggtgatgttgacctaaaggaagtgtacttcagctacccagcaagaccagagcaactaatatttgatggattctcattacatgtgtctagcggcactacaatggctatagttggggagagtggaagtggcaaatcaactgtgataagtcttgtagagagattctatgatccacaggctggtgaggttttaattgatggaatgaacattaagagtttgcgacttgattggataagaggggaagatcggccttgttaaccaagagccgttgctttttatgacttctatcaaagataacatatcatatggcaaagaggatgccacaattgaagagatcaaaagagcagctgagcttgctaatgcagcaaatttcatcgataaattgcccaacggctatgacacaatggttggccaacgtggtgctcagctctctgggggccaaaagcaaaggatcgctattgcaagagcaataattaaagaccccagaattcttttgttagatgaggcgactagtgcattggatgtggagtcagagcggattgttcaggaagcgcttaataggatcatggtgaatagaacaacactagtggttgcacatcgtctgactactgtgaggaatgctgattgcatatcagttgttcaacaagggaaaatagttgaacaaggtccccatgacaagttgataatgaattctgatggtgcttattctcaacttattcatctgcaagaaagccaagaagaggaagataagcaattagatcggcgcatgtctgatccaaggtctaaaagtagaagcctctcactgaagcgatcaataagcagaggttccacaggaaacagcagtcgccattctttgacgctcccatttggtatgcctggttcatttgagttgcttgaaggagatgatgcaaacagggagaatcagaaagagcgggctgatgatagtgaggcccctaagaaagctcctatgggacggctagcttgtcttaacaagccagagctaccaattcttttgttaggagcaatagcagctggagtccatggaacaatttttccaatgtttggtctaatgctttctaatgccatcaacactttctttgagccgcctcatgaactaagaaagcattcaagcttttggggtttgatgtgtgttgtgttgggtattatatcgatagtatcagtaccagtggagtatttcttatttggagtagccgggggaaagcttatcgagcgtattcgtaccttgtcatttcagagcattgtgcaccaagaagttgcttggtttgatgatcccaaaaactccagtggagcgcttggtgcaaagttgtcagttgatgctctgaatgttcgacgattagtgggtgataacttggccttgttgactcaggtcatctcaacactaatcactggatttgtcattgcttttgtggcagactggaagctcacattgatcatcctttgtgcaatgccactatcgggtgctcaaggttatgcacaaataaagttcttgaagggattcagtcaagatgccaagatgctgtatgaagatgcaagtcaagtggctactgatgcaatcagtagtatcaggactgtagcttctttttgtgctgagaaaagagtcatgacaatctatgatcataaatgtgaagcttccaagaatcaaggggtcagaacaggaatggtcggtggccttggttttggtttctcattcatgatgatgtaccttacatatggtctctgtttctatgttggtgggcaattcgtgcgtcataacaagtctagttttggagacgttttcagggttttctttgcactgatgatggcaacaattggcatatctcaaacaagtgcattggcttctgattctacaaaggcgaaggattcatctatctccatatttgctttattggaccgaaagtcaaaaatcgattcaggcagtgatgaaggtttgacattagatgaggtcaagggtgacatcgatttccgacatgttagcttcaagtatccaagtcgtccagatgttcaaatcttcagtgattttaccctgcacattccctctggaaagactgtagcacttgtgggagagagtggcagtggaaaatcaacaataatttctttgctggaacgattctacaatcctgactctggtacaatctcattggacggggtagaaatcaagagcttaaaagtcaattggctaagggaccaaatggggttggtgggccaagagcctgtgctcttcaacgacacaatccgcgccaacatagcatatgggaagcatggggaggtcactgaggaggagctcatcaaggtcgcaaaagcggccaatgcgcatgagttcatatcaagtcttccccaggggtatgacactaccgttggagagaggggggttcagctatccggtggccagaagcaacgggtggccattgcacgggctatactaaaagatcctaggattcttcttcttgatgaggcaacaagcgccttggatgctgagtctgagcgcattgtgcaagatgccttggataatgtcatggttggcaggaccacaattattgtggcacaccgcctctcaacgatcaaaagtgctgatattattgcagttctcaaggatggcgcgatagtggagaaaggaagacatgagacgttgatgaacatcaaagatggattctatgcttcgctagttgaacttcgttcatcttcatcgtagtacctaggttaagaattttgttccgatcactaggcattgtacatcttcctagattcttctctgcaagggcgacgccagagtcatttttcctgatgcacgtgcaccaggatctgagtgaagatttaaagctaattagtggagcaattacttgatgattatagagactttacagtttggacctcttcaacaaaagtttatcagagagactatcagtaataacaatcccatggaccgggtaggaaacttgcttagatgcttatgtcctctttcatcagaagcaatttatctccaaatctaatattgtgtccactgtttttcatagcacatgaaaccatagttcagactccaaa

SEQ ID NO: 401 - DNA, 4510 bp, Brachypodium distachyon
acttgtaatttcttcttccatttttccaagatatttcaaggcagtaatcatcccgcttgcgcggttgtgggctcgtggctccgcaagcagccaactccacattagtgcacttactccttagtccttactggatccttttagaggaccttggcagattactagccgtgcgttctgcgcacacgaaaattaagccagccgcgagctagctagagagcaatggaggcagcggcgaaagggagggatggctaggaggaggcggagcacgggaagaaggtgccgttcacggggctgttccggtacgccgacggcacggacctgctgctgatgctgatgggcaccctgggcgcgctggcaaacggcgtgtcgcagccggtcatgatcatcatcttcggcgatctcgtcgacgccttcggcggcgccaccaccgccaacgaggtcctcaaccgcgtcaacaagtcagttctgagctttgtctacttgggtgccggaacagcagtagtctcctttcttcaggtgtcatgttggacgattaccggcgaaaggcaggcgacgcgcattcggtctctgtatctcaaatctgtcttgagacaggatatatcattctttgacacagaaatgacaacaggaaaaatagtttcaagaatgtcgggtgatacggtgttagttcaggatgctatcggtgagaaggttggcaagtttctacaacttgtggcttcattcctcgggggatttgcagtagcttttgtcaaaggatggcttctatctcttgtcatgttggcatgcataccccctgttgtaattgctggaggagcagtgtcaaaagtgctatccaaaatctctagcagaggacaaacatcatacggtgatgcaggcaatgttgtagaacagacaattggagcaataaaaacagttgtctctttcaatggcgagaagcaagccatcgctacatacaataaactcatacacaaagcatacaagactactgtggaggaaggacttaccaatggctttggcttgggttctgttttcttcatatttttctctagctatggtttagccgtatggtacggtgggaaattgatacttagcagaggatactcaggaggtcaggtcatcactgtattgatggctatcatgactggggcaatgtctttaggtaatgcaaccccatgtcttccagcctttgcaagaggacaatctgccgcatataggttgttcacaacaatcaagaggaaaccagacatagatcctgatgacagaacaggtaagcagttagaagacatcaggggtgaggttgagctaaaggatgtgtatttcagctacccagcaaggcctgagcaactggtatttgatggattctcattacatgtggctagtggcactacaatggctatagttggagagagtggcagtggcaagtcaactgtgattagtctcgtagagagattttacgatccacaggctggtgaggttttgattgatgggatgaatatcagaagtttacggcttgactcaataagagggaaaattggtcttgttagccaagagcccttgctctttatgacctcaattaaagataatataacatatggcaaagaaaatgcaacaatagaagagatcaagagagctgccgagcttgccaacgcagcaaatttcattgagaagttgcccaatggttacgatacaatggttggccagcgcggtgcccagctttcagggggacaaaagcaaaggattgcaattacaagagcaatcattaagaacccaaaaatactattgttagatgaggctactagcgcattggatgtggggtcagagaggatagttcaggaggcactgaacagaatcatggtagacagaactagcctcgtggttgcacatcgtttaactactgtgaggaatgctgattgcatatcagttgttcaacaaggaaagatagttgagcaaggttgccacgatgaattagtactagacccagatggtgcttactctcaacttattcggcttcaggaaagtcgtgaagaagaagagcagaaagtagacagtcggatgtctgatccaatgtctaaaagtacaagcttgtcattgaagcggtcgattagtagaaattcttctcaaaatagtagtagacattctttcaccctcccctttgggctgcctggcacagttgaattgactgaaaccaatgattcaaacgggaataatgagaacaagcaggatggtgattgtgaggtcccaaagaaagctcccctgggacggctagcacttcttaacaagccagaggtacctattcttctgttaggatctatagccgcaggagttcatggagtgcttttcccattgtttggtgtgatgatttccagtgccattaaaactttctatgagccaccagagaagctcaaaaaggattctagtttttggggtctgatgtgtgttgtgcttggcatcgtttcaataatctcaataccagtagaaatgttcttgtttggaatagccggagggaagcttatagagcgcatccgcgcgttgtcctttcgaagcattgtacaccaagaagttgcttggtttgatgatcctaaaaactccagcggagcacttggtgcaagactgtcggttgatgctttgaatgtccggcgtttagtgggagataacttgggcttaacagttcagatcatttcgacactgatcgcaggatttatcattgctatggttgctgactggaagctctcttttatcatactgtgtgtgattccattagtgggtcttcaaggatatgcccaaatgaagttcttggagggtttcagtcaagatgctaagatgatgcatgaagatgcaagtcaagtggccacagacgcaattagtagtatcaggactgtagcttctttttgttctgagaaaagaattacaaacatatatgatcataaatgtgaaacgtcgatgaatcaaggagtcagaacaggattaattggaggcattggatttggtttctcattcttaatgttgtacctgacgtacgccctttgtttctacattggagcgcaattcgtgcgccaaggcaaatcaaattttggtgacgttttccaggttttccttgcacttgttatagcaactactggagtatctcaaacaagtgcaatggctaccgattcagcaaaagcaacagattcagctatctctatatttgctctgctggaccgaaattctgaaattgactcaagcagcagtgagggattgacattagatgaggtcaagggaaacatcgatttccgacatgtcagcttcaagtacccaactcgcccagatattcaaatcttcagtgactttaccttgcacattccttctggcaagactgttgcacttgttggagagagtggtagcggcaagtcaacagtaattgcattgttggagcgattctacaaccctgattcaggtaccatctcattagatggagtggaaatcaagagcttaaacatcaattggttgaggggccaaacaggactggtgagccaagagcctgtacttttcgacaacacaatccgtgccaacatagcctacggtaaggatggggaggtcacggaggaggagctcattgcggctgcgaaggcatccaatgcacatgagttcatatcaagccttccccaaggatatgataccactgttggggagagagggatacagctatccggtggccagaagcagcgggtagctattgcaagggccatgctgaaagatcccaagatactactacttgatgaagctactagtgccttggatgccgagtctgagcgcattgtgcaggatgctttagaccatgtgatgattggcaggaccacggttgttgtggcgcaccgcctctcgacgatcaaaagtgctgatatcattgcagttctcaaggatggtgcaatagtagagaaaggaagacatgagacgctgatgaacatcaaagatgggatgtatgcttcactagtagaacttcgtgcagcagcagcatgatacataggataagttttggtacttacctctattcatgtagtacatcactacatcttacttgatcccattttgttgctgtttaattatggtacagttattctttaggacttgaagaggaatttgagaattaagctagtgtttaatgtatctatgtagtgtaaaattgtatgcatttagaaggaatgcttctgtttctgtttttaattttgaagtgccttttcccatatcgatgtgtaaatgagtgtaatttctgttgtatgcctgtacctaataccaacataaatgtgaagatcagcttgcaaaattttaacatctgtgtaatacaaagattctcagctatctttttcagatgttctaggtattttctgtttagcaactgatattattgcggttaaatgagcaagtgcttaggtagggagtaaggagatgacaagaatcaagacttaccattgcaccagcaatgtcaaggtaggcactggaggatcagaggctccgaacgaccatatggagatcctga

SEQ ID NO: 402 - DNA, 3722 bp, Panicum virgatum
tgcattgtttgtgcagaggtgtcatgctggacaatgacaggagaaagacaggcaacacgcattcgatctctatacctcaaatctgtcttgaggcaagaaatagcattctttgatgtagaaatgacaacagggcaagttgtttcaaggatgtctggtgatactgtgttggttcaggatgccattggtgagaaggtcggcaagttccaacaacttattgcgaccttcataggtggctttgtagtagcattcgtaaaaggatggcttttatctcttgtcatgttggcatccatacctccaattgtcattgctggaggatttgtctcaaaaatgctctctagaatctctagcaaggggcaaacatcatacggcgatgcaggaaatgtagtcgaacagacgcttgggaacattaaaacagtggtctcgttcaacggtgagaagcaggctattgcaacctacaataaactcatacacaaggcatataaggcagctgttgaggaaggaattacaaatggttttggcatgggttctgttttctttatatttttctcaagctatggattagccatatggtacggtggcaagttgattcttagcagagattactcaggaggagacgtcatcaacatcttgtttgctataatgactggggcaatgtctttaggtaacgcaacaccatgcatggcagcctttgcagaaggacaatctgcagcatacagattgttcgcaacaatcaagaggaaaccagaaattgaccctgatgacccaaccggtaagcagttagaagacatcaagggtgatgttgatctaaaggatgtgtacttcagctacccagcaagaccagagcaactaatatttgatggattctcattacatgtgtctagcggcactacaatggctatagttggggagagtggaagtggcaaatcaactgtgataagtcttgtagagaggttctatgacccacaggctggtgaagttttaattgacgggattaacattaagagtttgcgacttgattggataagagggaagatcggtcttgttagccaagagccgttgctctttatgacatctatcaaagataacatatcatatggaaaagaggacgcaacaattgaagatatcaaaagagcagctgagcttgctaatgcagcaaatttcattgataaattgcccaacggctatgacacaatggttggccaacgaggtgctcagctctccgggggccaaaagcaaaggatcgctattgcaagagcaataattaaagaccccagaattcttctgttagatgaggcgactagtgcattggatgtggagtcagagcggattgttcaagaagcgctgaataggatcatggtgaatagaacaacactagtggttgcacaccgtctaagtactgtgaggaatgctgattgcatatcagttgttcaacaagggaaaattgtcgaacaaggtccccatgacgaattgataatgaattctgatggtgcttattctcaacttattcgtctgcaagaaagccaagaagaggaagttcagaaattagatcggcacatgtctgatccaagatctaaaagtagaagcctctcattgaagcggtcgataagcagagtttccgcaggaaacagtagtcgccattctttgacgctcccatttggtatgcctggttcagttgagttgcttgaaggaaatgatgcaaacagggagaatcagaaagaacaggttaatgatagagaggcccctaagaaagctcctatgggacggctagctggcctaaacaagccagagctaccaattcttctgttaggagcactagcagctggagtccatggagtgctttttccaatgtttggtctactgctctccaatgccatcaaaactttctatgagccgcctcatgaactaagaaagcattcaagcttttggggtttgatgtgtgttgtgctgggtattacatcgatagtatcagtaccaatggagtatttcttatttggagtagccgggggaaagcttattgagcgtattcgtgccttgtcatttcagagcattgtgcaccaagaagttgcttggtttgatgatccaaaaaactccagtggagcgcttggtgcaaagttgtcagttgatgctctgaatgtccgacgattagtgggtgataacttggccttgttggctcaggtcacctcaacactaatcactggatttgtcattgcttttgtggcagactggaagctcacattgatcatcctttgtgcaatgccactatcgggtgctcaaggttatgcacaaataaagttcttgaaaggcttcagtcaagatgccaagatgctgtatgaagatgcaagtcaagtggctactgatgcaatcagtagtatcaggacagtagcttctttctgtgctgagaaaagagtcatgacaatctatgatcataaatgtgaagcttcaaagaatcaaggggtcagaacaggaatggtcggtggccttggttttggtttctcattcatgatgatgtaccttacatatggtctttgtttctatgttggagggcaattcgtgcgtcataacaaatctagttttggagatgttttcaaggttttctttgcattgatgatggcaacaattggcatatctcaaacaagtgcattggcttctgattctacgaaggcaaaggattcatctatctccatatttgctttattggaccgaaagtcaaaaatcgattcaggcagtgatgaaggtttgacattagatgaggtcaagggtgacatcgacttccgacatgttagcttcaagtatccgagccgtccggatgttcaaatcttcagtgattttaccctgcacattccctccggaaagactgtagcacttgtgggagagagtggcagtggaaaatcaacagttgtttctttgctggaaagattctacaatcctgactctggtgcaatctcattggatggggtagaaatcaagagcctaaaagtcaattggataagggaccaaatggggctggtgggccaagagcctgtgctcttcaatgacacaatccgcgccaacatagcttatgggaagcataaggtggtcactgaggaggagatcatcaaggttgcaaaagcagccaatgcgcatgaattcatatcaagtcttccccaggggtacgatacaactgttggagagaggggggttcagctatccggtggccagaagcagcgggtggccattgcacgggccatactaaaagatcctaggattcttcttcttgatgaggcaacaagcgccttggatgctgagtctgagcgcattgtgcaagatgccttggataatgtcatggttggcaggaccacaattattgtggcgcaccgcctctcaacgatcaaaagtgctgatactattgcagtactcaaggatggtgtgatagtggagaaaggaagacatgagacactgatgaacatcaaagatggattctatgcttcactagttgaacttcgttcagcttcatcgtagtacctaggttaagaattttgttccaatcactaggcattgtacatcttccttgattcttctctttgtttttacagttcttgtgtgctatggatttattaggatttacagaagaattttcaagagtaaactttgcatcactgtaagcatttggttgacaatttgaacggcggactccatgtagatatgaaaagtagtggctctgtcaatatcaactactcatcccc

SEQ ID NO: 403 - DNA, 3864 bp, Setaria italica
tgtgcgtacacaccgagccgcgcgcgagcaatggcggacgctgccgcggtgacagctgcgaaagggctggaggagaagaagaaggagaagggcggcggcggcgatgcggggaagatggtgccgttcgtggggctgttcgggtacgccgacggcaaggacgtgctgctgatgctcgtcggcacggtggcggcgctgggcaacggcttcgcgcagccgctcatgacgctcatctttggccagctcatcaatgccttcggcggcgccaccaccgaaaccatcctcgaccgcgtaatcaaggttgttctgaactttgtgtacctgggcactgggacaggggttgctgcctttcttcaggtttcatgctggacaatgacaggagaaaggcaggcgacacgcattcgatctctgtacctcaaatctgtcctgaaacaagatgtagcattctttgatgtagaattgacaactggacaagcggtttcaagaatgtctggagatactgtgatagttcaggatgctattggtgagaaggtcggcaagtttctacaactgacttctaatttcattggcggtttcattgtagcatttgtgaaaggttggctactatctcttgtcatgctgtcatgcatacctccagttgtcatcgcaggcggagttgtctcaaaaatgctgtccaaaatatctagcaaggggcaagcatcatacagtgatgcaggcaatgttgtcgagcagacaatcggggccataaaaacagtcatctcctttaatggtgagaagcaggccattgcattgtacaataagttcacacacaaggcatacaaggctactgtcgaggaaggaataacgaatggctttggcaggggttctgttttcttcgtattcttcgctagttatggtctagcaatatggtcattagggcatgcaaccccctgcattgcagcttttgcagcaggacaatctgcagcttacagattgttcactacaatcaagaggaaaccagagattgatccagatgatgcatctggtaaggagctagaggacatcaggggtgatgttgagctaaaggatgtatatttcagctacccagcaaggcctgaacaactgatattcgatggattctcattacatgttcctaacggcaccacaatggctatagttggggagagtggaagtggaaagtcaactgtgatcagtcttgtagagagattctatgatccacaggctggtgaggttttggttgatgggattaacatcaagagtttgcggcttggttggataagagggaagattggtcttgttagtcaagagccattgctctttatggcatctgtcaaggataacatcagatatggaaaagaggatgcaacaatcgaagagatcaaaagggcagctgagcttgctaatgcagcaaatttcattgataaatttccaaatggctatgacacgtcggttggtcagcggggtgctcagctctctggggggcaaaagcaaaggattgctattgcccgagcgatcattaaaaatcccaaaatcctcttgttagatgaggctactagtgcattggatgtggaatcagagcgaaccgttcaggaggcactgaataggatcatggtggacagaacaacccttgtggttgcacatcgcttgagcactgtgaggaatgctgactgcatatcagttgttcagaaagggaaaatagttgaacaaggtcaccatgatgaattagtaataaaccctgatggtgcttattctcaacttattcggctccaaaaaagcccaaaagacaaacaaaaattagattgccgtatatatgacacaatgtctaaaagtagaaggctcacatcgatagaattgataggcagaagttctgcagggaacagcagtcggcactctttcatcctcccttttggcttgcctagctcagttgaattgcttgaaggcaatgatacaaatgagaatctgaaagaggaggctggtgacagcgggatcccaaagcagactcatcttggacggctggctaatctgaacaagccagagctaccatttattttgttagggtcacttgctgcagcagttcatggaatgcttttaccagtttctggtataataatatcaaatgctatcattattttctttgagccggcagacaaactaagaaaggattctcagttttggggattgctcggtgttgtgctgggtatcgtgtcaataatagcagtaccgctggagtacttcctttttggagtaactggaggaaagttgatcgagcgtattcgtgccttgtcatttcggagtattgtgcaccaagatgttgcttggtttgatgatccgaaaaattccagtggaacacttagtgcaagattgtcggttgatgctttgaatgttcgacgtttagtaggtgatagcttggccttggcagttgaggtcacctcaacacttataacaggatttgtcattgctatgatagcagactggaagctctgtttaataatcatctgtgtgattccactggtcggtttacaaggttatgcacaaataaagttcttaaaggggttcagtgaagatgccaagttattatatgaagacgcaagtcaaatggccacagatgcagtcagtagcatcaggactgtagcatccttttgcagtgagaaaagagtgatgacaatatacaatcacaaatgtgaagcctctaaaaatcaaggggtcagaacaggaatgattgcaggccttggttttggaatctcatacttgttgttgaatcttacatatggtctttgtttctatgttggggcacaattcatacatcatgacaaatctacttttagtgctgttttcaaggttttctttgctttgatgttggcaacatttggaatatctgaaacaagtgccttggcttctgattccaaaaaggccaaggaatcaactgtatccatatttgctttgttagaccggaagtcaaaaattgactcaggtagcaatgaaggtttgacattagacgaggtcaagggtgacattgatttccgacatgtaagcttcaagtatccaagccgcccagatgttcaaatcttcagtagttttacactgcatattcccactggcaagacagtagcacttgttggggagagtggtagtggcaagtcaacagtaatagctttgttagagcaattctacagacctgattcaggtaccatctcactggatggagtggaaattaagaacttaaaaataaattggctgaggaatcaaatgggactggtgagtcaagagcctgtgctttttaatgacacaatccgtgccaacatagcctatgggaagcaaggggaggtcactgaggaggagctcatcaaggtcgcaaagttagctgatgcgcacgagttcatatcaagccttccccagggatatcagaccactgttggggaaagaggggtgcagctatccggtggccagaagcagcgggtagctattgcaagggccatactgaaagatcctaggatattgttgcttgatgaggcgacgagtgccttggatgctgagtctgagcgcattgtgcaggatgccttggaccatgtgatggttggcaggactacggttatcgtggcgcaccgcctgtcaacaatcaaaggtgctgatatcattgcggttctcaaggacggcatgatagtggagaaaggaagtcatgagacactgatgaacatcaaagatggattctacacttcactagtcgaacttcgttcgagctcaccataggatctaacttgagcctctgttactagggacaagcattgtaaatcccccttgcctgttttctttgcttatatggttgaaattcgctgtgagatcactggaatttgaagaataatttaagag

SEQ ID NO: 404 - DNA, 3818 bp, Setaria italica
cctgctgctgttccactttactttcctttcaggcacttctgaattttgtctacctgggcattgcaacagcggttgtgtcctttctccaggtgtcatgctggacaatgacaggagaaaggcaggcaacacgaattagatctctgtaccttaaatctgtcctgagacaagaaatagcattctttgatgtcgaaatgacaactgggcaactagtttcaagaatgtctggtgataccgtgttggttcaggatgccattggtgagaaggtcggcaagttccaacaacatattgctaccttcataggtggctttgtaatagcattcataaaaggatggcttttatctcttgtcatgttggcatgcatacctccagttgttgtggctggaggaatggtctcaaaaatgctttttaaaatctctagcaaggggcaaacatcatacggtgaagcagggaatgtagtcgaacagacgcttggggccattaaaacagttgtctccttcaacggtgagaagcaggctattgcagcgtacaataaactcatacacaaggcatacaaggcagctgttgaggaaggaattaccaatggttttggcatggggtctgttttctgtatatttttctcaagctatggtttagccatatggtatggtggcaagttgattcttagcaaaggttactcaggaggagatgtcatcaatatcttgttagctataataactggggcaatgtcgttaggtaatgcaacaccctgcttggcagcctttgcagaaggacgatctgcagcatacagattgttcgcaacaatcaagaggaaaccggaaattgaccctgacgacccaagcggcaagcagttagaagacatcaagggtgatgttgacctgaaggatgtgtactttagctacccagcaagaccagatcaactaatatttgatggattctcattacatgtgtctagcggcactacaatggctatagttggggagagtggaagtggcaagtcaactgtcataagtcttgtggagagattctatgatccacaggctggtgaggttttaattgatggcattaacattaagagcttgcggcttgattggataagagggaagatcggtcttgttaaccaagaaccattgctctttatgacatctatcaaagataacatatcatatggcaaagaggatgcaacaattgaagagatcaaaggagcagctgagcttgctaatgcagcaaatttcattgacaaattgcccaacggctatgacacgatggttggccaacgtggcgctcagctctcagggggccaaaagcaaaggattgctattgcaagagcaataattaaagaccccagaattctgttgttagatgaggcgactagtgcattggatgttgagtcagagaggattgttcaggaagcactgaataggatcatggtgaatagaacaacaattgtggttgcacatcgtctgagtactgtgaggaatgccgattgcatatcagttgttcaacaagggaaaatagttgaacaaggaccccatgatgaattgataatgaaccctgatggtgcttattctcaacttattcgtctgcaagaaagccaagaagaagaggaacagaaattagaacgtcgcatgtctgataaaaggtctaaaagtagaagcctctcactgaagcgatcgataggcagaggttctgcaggaaacagcagtcggcattcttcgacggtcccatttggtatgcctggttcagttgggttgctcgaagacaatgatacaaacggggagaatcagaaagagcaggctgatgatagtgaggccccaaagaaagctcctatgggacggcttgctgctctaaacaagccagaggtaccgattcttttgttaggagcactagctgctggagtgcatggagtgctttttccaatgtttgggctattgatctccaatgccatcaaaactttctatgagccgcctgacaaactaagaaaggattcaagcttttggggtttgatgtgtgttgtgctgggtattgtatcgataatatcagtaccagtggagtttttcttgtttggtgtcgcaggggggaagcttatcgagcgtattcgtgccttgtcatttcggagcattgtgcaccaagaagttgcttggtttgatgatcccaaaaactccagtggagcacttggtgcaaagttgtcagttgatgctctaaatgtccgaagattagtgggtgataacttggccttgttagctcaggtcacctcatcgctaatcactggattggtcattgcttttgtggcagactggaagctcacattgatcatcctttgtgcaatgccactatcgggtgctcaaggatatgcacaagttaagtttttgaagggcttcagtcaagatgccaagatgctgtatgaagatgcaagtcaagtggccactgatgctatcagtagtatcaggactgtagcttctttctgtgctgagaaaagagtcatggcaatctatgatcataaatgtgaagcttcaaagaatcaaggggtcagaacaggaatggttggtggccttggttttggtttctcattcatgatgatgtaccttacatatggcctttgtttctatgttggagggcaattcgtgcgtcataacaaatctacttttgcagacgttttcaaggttttctttgcactgatgctggcaacaattggcatatctcaaacaagtgcattggcttctgattctacaaaggcgaaggattcatctgtctccatatttgctttattggaccgaaagtcgaaagttgactcaagcagtgacgaaggtttgacattagacgaggtcaagggtgacatcgacttcagacatgttagcttcaagtatccaagccgtccagatgttcaaatcttcagtgattttaccctacacataccctccgggaagactgttgcacttgtgggagagagtggcagtggaaaatcaacagtaatttctttgctggaacgattctacaatcctgactctggtaccatctcactagatggggtagaaatcaagagcctaaaggtcgattggctaagggaccaaatagggctggtgggccaagagcctgtgctcttcaacgacacaatccgcgccaacatagcatatgggaagcacggggaggtcactgaggaggagctcctgaaggtcgcaaaggcagccaatgcgcatgagttcatatcaagccttccccaggggtatgacaccactgttggagagaggggggttcagctatctggtggccagaagcagcgggtggccatcgcaagggccatactaaaagatccaaagattcttcttcttgatgaggcaacgagcgccttggatgctgagtctgagcgaattgtgcaagatgccttggacaatgtcatggttggcaggaccacagttattgtggcacaccgcctctcgacgatcaaaagtgctgatattattgcagttctcaaggatggcgtgattgtggagaaaggaagacatgagacgctgatgaacatcaaagatggattctacgcttcgctagttgaacttcgttcagcttcgtcatagtacctagctaggttaagaattttgttcgcatcactaggcattgtacatcttccttgattcttctctttgtttttatatagttatatggtgtgctacgaattcattgggatttaccgatttacagaagaacttcgagaagtaaacttctctttgcatcactgtaagcttttggttgacattttgaactatggactctgtgtagatacgcaaagaggtcatgatttgtgcaactatgtggctctactgatc

SEQ ID NO: 405 - DNA, 1723 bp, Zea mays
ctttgctctgcctgtcttgacgggcgcgccaagttagaccacgtggtcagcagccaagtccaatttttcttgatccttatcattaggtaaagttcagatgaggttatatgatttattgattgattgacgtcaccattagcaatataaaacgtgcgcccactcgcccgaaaaccacactgtcagtcagtcggtggcagagacgagcaccttctccagtttttttctcagttctcactccatggccgccgcggcctgcaacccagtggctccttccgggcctgtgccgttcaaggacgtcgacgacggcagtgttccagagcacactcccaaggaggagttcggcgacctcgtggccgcgctgccgagcaggcagcagtccatcctggagctgcgcctgtaccagggcttctggctgccggagcactgggtgccggggaccatcgtgttccagcgccgcttcacgccgcgccccgacgacgtgatcctcgcgagctaccccaagtgcggcaccacgtggctgaaggcgctggccttcgccacggcggcgcgtacggcgtacccgcccggtggcgccaggcacccgctccgacggctcaacccgcacgactgcgtcccgttcatcgacgagatcttcgccagcggggaggaggcgaagctcgaggccctcccgtcgccgaggctgatgaacacgcacctgccctacgccctgctcccggcgcccgtcaccgccaccgccaccgggtgcagggtcgcgtacgtgtgcagggaccccaaggacatggtggtctcgctctggcacttcctccggcgcgccaagccggacctcttgttcgccgacacgttcgagtccgtctgcgacggcaccgtggtggccggcccggtctgggaccacgtcctctcctactggcgtgcgagcgtggcggccccggacagggcgctcttcctcaggtacgaggacatgctgcgggaccccggcggcaacgtgcggcggctcgccgagttcatgggccgcccgttctcggccgccgaggaggccgccggcgacgtcgcggccgtcgtggagctctgcagcttcgacgagatgaaagggctggaggtgaacaggcctggtagcggcaccgcggggaggtaccgccccatgccgcgcgacgccttcttccggaagggtgtcgccggggactgggcgaaccacatgacgccggagatggcggcgcggctggacgggatcttccgtgaaaagctccaagggacggggcttatcttctcataatgcaaatgtgtatacggctcttgatttgcgtggtcatctcttctgatcttttccgtggtgtcttgtgtttacacgagattggaataaagagagatgatttaatatatacatcatatgcatcaatctcccatgtacaccagatatgttttcccttttatattgttcacacgaattcgatcaaattaattatccatagcacgtgggacaatgctgcggccagttcgctaaataagactataggagcaagtgcaacaatggattaatgggctctaaatctgcttagggcatgtacagtggagagacaccaaaacggttctccaagcacagaagacaactaagagactctgttgtacaatggagtgtctataaacgtagtctattaataaatacagaattaaatgtatttgtatagcattagatcgatagaacagacgacaaattcgtacagtggga

SEQ ID NO: 406 - DNA, 1704 bp, Zea mays
cccactgtacgaatttgtcgtctgttctatcgatctaatgctatacaaatacatttaattctgtatttattaatagactacgtttatagacactccattgtacaacagagtctcttagttgtcttctgtgcttggagaaccgttttggtgtctctccactgtacatgccctaagcagatttagagtccattaatccattgttgcacttgctcctatagtcttatttagcgaactggccgcagcattgtcccacgtgctatggataattaatttgatcgaattcgtgtgaacaatataaaagggaaaacatatctggtgtacatgggagattgatgcatatgatgtatatattaaatcatcactacttattttggatctaacatatctcgtgtaaacacaagacaccacggaaaagatcagaagagatgaccacgcaaatcaagagccgtatacacatttgcattatgagaagataagccccgtcccttggagcttttcacggaagatcccgtccagccgcgccgccatctccggcgtcatgtggttcgcccagtccccggcgacacccttccggaagaaggcgtcgcgcggcatggggcggtacctccccgcggtgccgctaccaggcctgttcacctccagccctttcatctcgtcgaagctgcagagctccacgacggccgcgacgtcgccggcggcctcctcggcggccgagaacgggcggcccatgaactcggcgagccgccgcacgttgccgccggggtcccgcagcatgtcctcgtacctgaggaagagcgccctgtccggggccgccacgctcgcacgccagtaggagaggacgtggtcccagaccgggccgaccaccacggtgccgtcgcagacggactcgaacgtgtcggcgaacaagaggtccggcttggcgcgccggaggaagtgccagagcgagaccaccatgtccttggggtccctgcacacgtacgcgaccctgcacccggtggcggtggcggtgacgggcgccgggagcagggcgtagggcaggtgcgtgttcatcagcctcggcgacgggagggcctcgagcttcgcctcctccccgctggcgaagatctcgtcgatgaacgggacgcagtcgtgcgggttgagccgtcggagcgggtgcctggcgccaccgggcgggtacgccgtacgcgccgccgtggcgaaggccagcgccttcagccacgtggtgccgcacttggggtagctcgcgaggatcacgtcgtcggggcgcggcgtgaagcggcgctggaacacgatggtccccggcacccagtgctccggcagccagaagccctggtacaggcgcagctccaggatggactgctgcctgctcggcagcgcggccacgaggtcgccgaactcctccttgggagtgtgctctggaacactgccgtcgtcgacgtccttgaacggcacaggcccggaaggagccactgggttgcaggccgcggcggccatggagtgagaactgagaaaaaaactggagaaggtgctcgtctctgccaccgactgactgacagtgtggttttcgggcgagtgggcgcacgttttatattgctaatggtgacgtcaatcaatcaataaatcatataacctcatctgaactttacctaatgataaggatcaagaaaaattggacttggctgctgaccacgtggtctaacttgg

SEQ ID NO: 407 - DNA, 1327 bp, Setaria italica
cactgacagtccaattgcttcgcttctctgccagcacgcgcgccctctgcttctcacttccatggccatggacgccgctgccgccaacacggtggttccttcgggccctgtcccgttcaaggacgtcgacgacggcaccgtcccggagcacactcccaaggaggagttcggcgacctcgtggccgcgctgccgcgccggcagcagtccatcctggagctgcgcctgtaccagggcttctggctgccggagcactgggtgccgggcaccgtcgtgttccagcgccgcttctccccgcgccccgacgatgtggtcctcgccagctaccccaagtgcggcaccacgtggctcaaggcgctggccttcgccgccgcggcgcgcggcgcgtacccgcccgccgcccccgggcacccgctccgccggctcaacccgcacgactgcgtcccgttcatcgacgagatcttcgccggcggggaggaggccaagctcgacgcgctcccgtcgccgcgcctcatgaacacgcacctgccctacacgctgctcccggaccgtgtcaccaacgcaggcgggtgccgcgtcgtgtacgtctgcagggaccccaaggacatggtcgtctcgctgtggcacttcctccggcgcgccaagccggacctctcgttcgtcgagacgttcgagtccgtctgcgacggcacggtggccgccggcccggtctgggaccacgtcctctcctactggcgcccgagcgtggcgcgtccggacagggtgctcttcctcaagtacgaggacctgctgcgggacaccgccgcgaacgtgcggcggctggccgagttcatgggccggccgttcaccgccgccgaggaggccgccggcgacgtcgcggccgtcgtggagctgtgcagcttcgatgagatgaaggggctggacgtgaacaaggctggcagcggcaccgcggggaggtactgcgccatgcagcgcgacgccttcttccggaagggggtcgccggggactgggcgaaccacatgacgccggagatggcggcgcggctggacgggatcattcgcgagaagttgcaaggaactgggctcgacttcgcgcagggatcatctcgagatgttgacgtttagggagcgaatctctccgattctctcgatcggcgcgttgtgtttgaataattgaatctgttttgggactttctccgtggccacattagagaagtttggcgcactcccatctgtttcgatcgtgcaataatgcaaagtgccaacatatgtggaataaaaaatgaatttgtatttgtcacatgaatgaatttgattaaggtagcacga

SEQ ID NO: 408 - DNA, 938 bp, Zea mays
gcagccgttgaaagcgagcagctcaacaccatgtcgactcccgcgcttgcgactgctgccgagggagcgacgcgcatcatcctggtgcacggcacgggccacggcgggtggtgctggtaccgggtcgccacgctgctccgcgccgcgggacaccgcgtggacgcgccggacctcgcggcgtcgggcatcgactcgcggcagctccgcgacgtgcccaccttcgaggactacacgcggccgctgctcgacgcactccgggcgctcccgccgggagagagggcggtcctggtgggccacagcttcggcggcatgagcatcgcgctcgccgcggagacgttcccggagaaggtggcggccgccgtgtttgtcaccgcgttcctgccggactgcaccaacccgcgctcgcaggtcatcgagaaggttaccgtgtcagactggatggacaccgtcacggatgcagagcacgttccagcctcggtgttcctggggcctgaatttctgcgccacaagctctaccagctgagcccaccggaggactacacgctgtcccagagcctggcccgggtgagctcctactacgtgcccgacctgcagagccagacgccgttcagcgaggccaggtacggcgcggtgagcaagatgtacgtggtctgcaagcaggatcaggccatgaccgaggcgtaccagcacacgatgatcgccgcctgccccgtggcggaggtgagggagatcgccgacgccgaccacatggccatgttctccgcgccggctgagctcgctggccacctcgcccacgtcgccaacacgtacgcttgataccagtaccaatgttttgtaagaaacgtctcccctagtgaaaatggcaaatgctccggtaatactgtacttcacaggctgttttcaaaatattgttgcgagctgccaagaatggaaatgta

SEQ ID NO: 409 - DNA, 1707 bp, Setaria italica
acatctgatgtgacaagtgctaaactttagcacgtgggagccaaacatcgctgcagtttgttggctcagcacacaaaatgtgacataggctttgcacgtttgccggcgccggtttcttcattgcgttgccatcggttgccatgccatgtgcccacgaggccacgacagaggagttgtcaaccaacatcatctcaaaacgagaaaaaagcaaaccatcagcgcttgactgttacgggcacggagagtggtgcgcatctatgagtgtgtgtccattccagccgcccctcgacatcagccgtgacgatctcatcatatccccaagcgtagcaaaggtaaacctctgcatatatatggtcgatgtaccttctcactactgcaagaggccacggagagaaaccactagccagcaccatgtctccgcctccggcgattatccccacggcggccgagggcgcggcgcgcatcatcctggtgcacggcacgggccacggcggctggtgctggtaccgcgtggccacgctgctccgcgccgctggccaccgcgtggacgcgccggacctcgcggcctcgggcgccgacgcgcgccggctccgcgacgcgcccaccttcgaggactacacgcgcccgctgctggacttgctccaggcgctccccgacggcgagcgggccgtcctggtcggccacagcttcggcggcatgagcgtcgcgctcgccgccgaggcgttcccggacaaggtcgcggccgccgtgttcgtcaccgcgttcctgcccgactgcaccaacccgcgctcgcatgtcatcgagaagcttaccctgacggactggatggacagcgtgacggacgcggagcacgacccgccctcggtgttcctagggcctgagttcctgcgggagaagctctaccagctcagcccgccggaggactacacgctgtcgcagagcctggcccgggtgagctcccactacgtggccgacctgcggggccagccgccgttcagcgaggcgcggtatggcgcggtgcgcaaggtgtacgtggtgtgcgaccaggaccaggccatgctcgagccctaccagcgggcgatgatcgccggctgccccgtggccgaggtcagggcgatcgccggcgccgaccacatggccatgttctccgcgccggccgagctcgcggggcacctcgccgacgtcgcaaacacgtacgcctgatgcggtgggtgcccatcgtttggtccgccacagcgggcgcgttgcagcctgtcagatattctggtcttctggatggaggcgtcctggtaccgccaccgagtaaataaacctatgatggtgaaggactgaagggcatctttcttcaatttggacccccgtactgttgaacacgcattgagatatatgggtacatgtgatgtagtgatatgaaagactgtctggatttcagtttttggggttcactgattgaagggaaagttaactgatttctatatgggacaactggcgagcaactgaaattatacatgtcattgggtatctataccctctccctagatccctaaatccatacttaggtagaaaattatatatccattacaaatgaggagggtagggacgtagggtataagaatagtacaattaatcaattgagtatgtatacatgtgtgtatatatatggacctccgcttttcagtatggatacataatattattatgctgtac

SEQ ID NO: 410 - DNA, 1483 bp, Hordeum vulgare
ccgcgctggaccaaagtcagagttctccttccccgtccagcacaaggaatccggccatccaaccgacctgcctccatccatccaatttgtcacgtgaagatgggatcatcatctcctcgatcggccttccacccaccttccaatccatgctgttataattataaatgcgtcacccagtgaagctcctgcttccttccatcggctcgtgcggctcactcggtctcactcttcaccactctgctatttctttccggctaacacaagcgacgccgtgcggtggatggagggcgtcgaggagatcgtcatcgccggcgccgggctcgccggactcgccacggccctggggttgcacaggaaaggggttcggagcgtggtgctggagtcgtcggcgacgctgcgggcgtcggggtacgcgttcaacacatggaccaacgccttccgcgcgctcgatgccctcggcgtcggggacaagatcagggagcaccacctgctctacgagaggctggtggccttctctgcatccacaggcgaggctgccgcggaagtgagcctaaagatgcagggcaaaagcggtcctcacgaaattcgttgcgtgaagcgcaacttcctgctggagacgctggagaacgagctgccggagggcaccatcaggtactcctcaaagatcgtcgccatcgaggaagaaggcagcgtcaagctcctgcacatggccgacggctccaccatgagagccaacgttcttgtggggtgtgacggagtgaactcggtggtggccaagtggctgggcctgcccaagccgatcctctccgggcggtccgccaccaggggcatggccgagtacccggacggccacggcttccgtcccgagatcctgcagttcatcgggcagggcttccgctccggcgtgctcccatgctccgacacctccgtgtactggaactacacctggtacccgtccccggccgacggggacgcggaggagagcgtggccaagatgcggcagcacgtgctggccaagctgaaggccgccaagatcccggcggaggcgttggacgtgatcgagcggagcgagatgagcgaggtggtgtcgtcgccgctgcggttccggtccccgctgtcgctggtccggggcagcatctgcaggggcggcgtgtgcgtggccggcgacgcgttccacccgatgacgccggagctcggccagggcggctgcgcggcgctcgaggatggcgtcgtcctcgcccggtgcctcggcgtggccttcgccgccggcgggcacgggagcgccgaggccgccctggcgaagtacgccgaggagcggaggtggcgcgccatccggctggtcacggccgcgtacgtcgtcggcttcgtgcagcagagcagcaacccggcgatcaagttcctcagagagaagttcctgtcggggttgctagccagagtgatggtcgacatggccgactacgactgcgggaagctctagtactgc

SEQ ID NO: 411 - DNA, 2181 bp, Triticum aestivum
acccacgcgtccgctctctctctattcttcttgctctagcactctgcactgctctgttccttccggctaacaccggctacgcccaccccacggtggatggagggcgtcgaggagatcgtcatcgccggcgccgggctcgccggcctcgcgacggccctggggttgcacaggaaaggggtgaggtgcgtggtgctggagtcgtcggcgacgctgcgggcgtcggggtacgccttcaccacatggaccaacgccttccgcgcgctggatgccctgggcgtcggggacaagatcagggagcaccatctgctctacgagaggctggtggccttctctgcatccacaggcgaggctgccgcaaaagtgagcctaaagatgcagggcaaaagcgggcctcacgagattcggtgcgtgaagcgcaacttcctgctggagacgctggagaatgagctgccggagggcaccatcaggtactcctccaagatcgtcgccatcgagatcgaggaagagggcaacgtcaagctcctgcacatggccgacggctccaccatcagagccaacgttcttgtggggtgtgacggagtgaactcggtggtggcgaggtggctgggcctgcccaagcccatcctctcggggcggtccgccaccaggggcctcgccgagtacccggacggccacggcttcgggccggagatgctgcagttcatcggccagggcttccgctccggcgtgctcccctgctccgacacctccgtgtactggaactacacctggtacccgtccccggcggacggggacgcggaggagagcgtggccaagatgcggcggcacgtgctggccaggctgacggccgccaagatcccggcggaggcgctggacgtggtcgagcggagcgagatgagcgacgtggtgtcgtcgccgctgcggttccggtcgccgctggcgctggtccggggcagcatctgcaggggcggcgtgtgcgtggccggcgacgcgttccacccgatgaccccggagctcgggcagggcggctgcgcggcgctggaggacggcgtcgtcctcgcccggtgcctcggcgaggccttcgccgtcggcgggcacgggagcgccgaggcggccctggagaagtacgcccaggagcggaggtggcgcgccgtccggctggtcactgccgcgtacgtcgtcggcttcgtgcagcagagcagcaacccggcgatcaagttcctcagggagaagttcctgtcgggattgctggccagagtgatggtcgacatggccgactacgactgcgggaagctctagttctgtcattccttcttcacggcaaaacgagaacgacgagagaaaacgaatcagttaaaacggcatcaatcaaatcgattggatgcctgtatttcgacttttcgagttaaataaagaaaataatttgatacctgataggattattagtctacaatatgtagatgataccctctatttcatggaaaacagtcagaaaatggcaataaaatggaggaagcacctatagcttaaggcatgtataatggttgataagatagtcttatcttaggtcttgcatgtaattaagagatgataaaaaaaagatgtctacaatgaatcatttcttagtaattactgtagttatttctaaaaacatgatgagacattatgctaaaagatcatctcttgttttcttttaaatataaaagaagacaagtctgtcttagtatgagttcttcctcctccatctcatcatgtatcctacatgacacttctaagatagcatcatcgtacattcctaataaaaatcgatcggagctgctaatccatgccatgctttgcagtagagaccacactacaaatctacgcagcaacattatttttcccaaacgacacgattaaagcttcccaaaagacactgatttaacctcccctgaagtatccaaacctccatttcttcgcttaatttgcagtaataaccaaagcagaaagtactaaaaacggggcgacccgcaccacctcccaaactaataatcaacgaacgaacaaaatgagcacgcccatagctgtcaatcaacacatgcccctcggtgagtgacgccatcattctcaaccttcctctgcttgctggttgctgctgcgcccgtctccgtcgccttccgtacacaacttattctttcttcc

SEQ ID NO: 412 - DNA, 1798 bp, Brachypodium distachyon
tccattggcatcttgtaggagtatcaagtagcgctacggtcccgaaaccgttttccaataagaccctgacaacttgcagtgcaaggctcctgcaccgccgcctgcctggaccaaagtcagaattttccttcccagtccggaacccggtcgtctcccgtcgacccaattcggcacatgccggtgatcatctcggcctctcatcagccacaccacctcgcatgctgttataaatacagtacatcagagaaagctcctggttccatcagatccgcccgcgactctcctcactcctcagtcctgaccttcttcctctaggcttctttactctgtcccaacttccaatcaacagcagccgcgacgtcccacggcgcggtgcaagacatggaaggcgttgaggacatcgtcatcgccggtgccgggctcgccggcctcgcgacggccctggggctgcacaggaaaggggtgagaagcgtggtgctggagtcgtcggcgacgctgcgggcgtcggggtacgccttcaccacatggacgaacgccttccgcgcgctcgatgcccttggcgttggggacaagataagggagcaccatctgctgtacgagaggctggtggccttctctgcatccacaggcgaggctgccgcaaaagtgagcctaaagatgcagggcaaaagcgggcctcacgaaattcggtgcgtgaagcgcaacttcctgctggagacgctggagagcgagctgccggagggcaccatcaggtactcctccaagatcgccgccatcgatgaggaaggcgacgtcaagctcttgcacatggccgacggctccatcataaaagcaaaggttctgataggatgtgatggggtgaactccgtggtggcgaaatggctgggccttccgaagccgatccagtcggggcggtcggccaccaggggcatggccgagtacccggacggccacggcttcggccccgagatgctgcagttcatcggccagggcttccgctccggcgtgctgccctgctccgacacctccgtctactggaactacacctggtacccctccccagatgacaaggacgccgaggagagcgtggcgaagatgcggcagcacgtgctaaccaagctccgggcagccaagatccccttggaggcgctggacgtgatcgagaggagcgagatgagcgaggtggtgtcgtcgccgctgcggttccggtcgccgctgtccctggtccgtggcagcatcagcaggggaaacgtgtgcgtggccggcgacgcgttccacccgatgaccccggagctggggcagggcggctgcgcggcgctcgaggacggcgtcgtgctggcccggtgcctgggcgacgccttcgcccacgggtacgcctgcgagtccgtgaaggcgggtttggagaagtacgccgacgagcggagggggcgcgcgatccggctcgtcacggcggcctacgtcgtcgggttcgtgcagcagagcaacaacacggtggtcaagttcctcagggagaagttcttgtccggattgctggcgaaactgatggtcgacatggccgatttcgactgcggagagctgtgatttttcgacccggtagaacgaaaacgatgaggaaaaatgcatcaaatccgactctcaccgaagcaactgacagtgcacctctttgctgccggccggcgcatatgctcaccttgagcacctttttttcttttcttcgaagaataattttgcttttgcgaagtgtcatcgagcacctgcttatagtaccatttaataataaataaaattaaattccagg

SEQ ID NO: 413 - DNA, 1368 bp, Avena sativa
ctcctcgctccagcattcttcactctgttcaccagctacatacgccccacggtgcacggcgcaagcaatcaatggcggccgtcgaggacatcgtcatcgccggcgccgggctcgccggcctggccacggccctggggttacacaggaaaggggtgaggagcctggtgctggagtcgtcggcgacgctgcgggcgtcggggtacgccttcaccacgtggaccaacgccttccgcgcgctggatgccctcggcgttggggacaagatcagggagcaccacctgctctacgagaggcttgtggccttctctgcgtccacaggcgaggctgctgcaaaactgagcctgaagatgcagggcaaaagcgggcctcacgaaatccggtgcgtgaagcgcaacttcctgctggagacgctggagaaggagctgccggagggcaccatccggtactcctccaagatcgtcgccatcgaggaggaagaaggcaacgtcaagctcctgcacatggccgacggctccaccatcagagccaacgttctggtcgggtgtgacggagtgaactccgtggtggccaaatggctgggcctcccgaagccgatcctgtcgggtcggtccgccaccaggggcatggccgagtacccggacggccacggcttcgggcccgagatcctgcagttcatcggccagggcttccgctccggcgtgctgccctgctccgacacctccgtgtactggaactacacctggtacccgtcccggaaggacgacggggacgcggaggagagcgtggccaagatgcggcagtacgtgctcaccaagcttaaggccgccaagataccagccgaggcgctggacgtgatcgagcggagcgagatgagcgacgtggtgtcctcgccgctcaggttccggtcgccgctggcgctggtccggggcagcatcagcaggggcaacgtgtgcgtggccggcgacgcgttccacccgatgaccccggagctgggtcagggcgggtgcgcggcgctcgaggacggcgtcgtcctcgcccggtgcctcggcgaggccttcgtcggcgccgggaacgacggcgggcacgcgtgcgtcaaggcggccctggagaggtacgcccaggagcggaggtggcgcgcgatcaggctggtcacggcagcgtacgtcgtcggcttcgtgcagcagagcagcaacgtcgcgatcaagttcctcagggagaagttcctgtcgggactgctggccagagtgatggtcgacatggctgacttcgactgcgggaagctatgattcttttctgatcgcccagtaggacgcaatcgatatactagtaggacaaaatgaattaaaacggagacacagtcgtgggagg

SEQ ID NO: 414 - DNA, 1622 bp, Secale cereale
gagagatgatcacctcctcgatcggccttccagccaccttccaatccatgctgttataaatacgtcacacagtagagatcctgttccatcagatcccgcgactcgcccttcttcttgctccagcactcttcgctactctgttctttcgggctaacaacaccggctacgcccaccccacggtggatggagggcgtcgaggagatcgtcatcgccggcgccgggctcgccggcctcgcgacggccctggggttgcacaggaaaggggtgagatgcctggtgctggagtcgtcggcgacgctgcgggcgtcggggtacgccttcaccacatggaccaacgccttccgcgcgctggatgccctcggcgtcggggacaagatcagggaacaccatctgctctacgagaggctggtggccttctctgcatccacaggcgaggctgccgcaaaagtgagcctaaagatgcagggcaaaagcgggcctcacgagattcggtgcgtgcagcgcaacttcctgctggagacgctggagagcgagctgccggagggcaccatcaggtactcctccaagatcgtcgccatcgaggaagagggcaacgtcaagctcctgcacatggccgacggctccaccatccgagcgaacgttcttgtggggtgtgacggagtgaactcggtggtggcgaggtggctgggcctgcccaagccgatcctctcggggcggtccgccacccgaggcatggccgagtacccggacggccacggcttcgggcccgagatcctgcagttcatcgggcagggcttccgctccggcgtgctcccctgctccgacacctccgtgtactggaactacacctggtacccgtccccggcggacggggacgcggaggagagcgtgggcaagatgcggcagcacgtggtggccaagcttcgggccgccaggatccccgcggaggcactggacgtggtcgagcggagcgagatgagcgaggtggtgtcgtcgccgctgcggttccggtccccgctggcgctggtccggggcagcatctgcaggggtggcgtgtgcgtggccggcgacgcgttccacccgatgaccccggagctcggccagggcggctgctcggcgctcgaggacggcgtcgtcctcgcccggtgcctcggcgaggccttgggcggcggcgggcacgggagcgccgaggcggccctggagaaatacgccgtggagcggaggtggcgcgccatccggctggtgacggccgcgtacgtcgtcggcttagtgcagcagagcagcaaccgggtgatcaagttcctgagggagaggttcctgtcggggctgctggcgagagtgatggtcgacatggccgactacgactgcgggaagctctagttctcttctgccattccttccttcacggtagaacggaaacgacgagagaacggattccttactataaacgccatcaatcaaatcgatttgatgcctgtatttcgacttttcgaggtaaataaagaacaattttgctaaaaagaaaaaaaaaaaaaaaaaaaaaaaaaaaaaaaaacaaaaaaaaaaaaaaaaaaaaaataaaaaacaagagtaagacgaacacacaacgaagacgagtagat

SEQ ID NO: 415 - DNA, 2031 bp, Panicum virgatum
ctaaaatccaaatcatttggagcctataaatactgtacatgtgtaacttccactcgaaggttctcgtctttcttgccactccgctttgtgcgccctgcctcgtaaaattcatccataaaaaaagagtgcgcagcgtgcgtccacctgacctgatccgttcccgacagcgccggggagccgggtcgcggtcagccatggcgatcgaaggtcagcagcagccgctgcacatgctcttcttcccgttcctggtgccggggcacctcatcccggccgccgacatggccgcgctcttcgccgcccgcggcgtcaagtgcaccatcctcaccacccccgtgaacgccgcggtcatccgctcggcggtggaccgcgccaacgaggcctcccgcggcgccgatggcgccctggccatcgacatcgccgtcgtgcccttcccggacgtcgggctgccccccggcgtcgagtccggaccggcactcaactccgatgccgaccgcgagaagttcttccaggcgctccagctgctccgggagcccttcgaccggttcctggcggagaaccgcaccgacgccgtcgtgtccgacagcttcttcgactggtccgcggacgccgcggcagagcacggcgtcccgcggctggggttcctcggaaccagcctgttcgcgcgggcctgcagcaacagcacggcgcgccacaaccccgtggaggccgcgcccgaggaccccgacgcgcccgtgctgctcccggggctgccgcaccgcgtcgagatgcggcgcagccagatgatggagcccaagaagcggccggatcgctgggccttgctccagcgcatgaacgccgcggaccagaggagctacggcgagttgttcaacagcttccgcgagctggagccggactacctggagcactacaccacgacgctcggccgccgcgcgtggctcgtcgggccggtcgccttcgccagcaaggacgtggcgacgaggggcgctgacgacgagggtctctcgcccgacgcggacggctgcctgcggtggctggacaccaagccggccgggtcggtggcgtacgtgtccttcggcacgctgtcccgtttctcgccgcccgagcttcgcgagctcgcgcgcggcctcgaccagtccggcaagaacttcgtctgggtcgtcggcggcggcgcggatgacgccgaggagtcggagtggatgcccgacgggttcgcggagctgctggcgcgcggcgagcgcgggctcatcatccggggctgggcgccgcagatgctgatcctaaaccacgccgccgtgggcggcttcgtgacgcactgcggctggaactcgacgctggaggccgtgggcgccggcgtgccgatggtgacgtggccgcggtacgccgaccagttctacaacgagaagctggtggtggagctgctcaaggtcggcgtcggcgtcgggtccacggactacgcgtcgaagctggaggcgcggcgggtgatcggcggcgatgtggtcgccgaggccatcgagagggtgatgggcgacggcgaggaggcgcaggcgatacgagaaagggcgagggtgctcggggagaaggccaggcgcgccgtggagaagggcgggtcctcgtacgatgacgtcgggcggctcatggacgagctgatggctcgtaggggcctcgtcaatgtctgattggtggaagcgcgtcgaaaatggaaggttggggttcggtagcgacggggcgaatgcgaatctgaatatggttatcagtgacagccactgactagagtcgtagagttcgtgccatccatcgtgtggaaaggaaaagtattcagggtgtgtttagatgccccaaacccaccccaaaatccaaactttccatcacatctccatcacatcgaaacattaaatatagcaaatgacttatgcatgaagtactacatgtaggtaaataaaaaaactaattgcatagttttgatatacgttgcgagacgaatattttgagcctagttaggtcatggtaggacaatatttaccacaaacaaac

SEQ ID NO: 416 - DNA, 1514 bp, Zea mays
cccggcccagcacccctgcaggtaggcaggtagctttggcggccgccatggccggaggagacggcgcggacgagataacgctggagcacacgcccacgtggatcgtggcctccgtatgttccatcatcgtcgtcatctccctgctcttcgagcgactgctccaccgcctcggcaagaggctagcaaaaggccgccggaagccactgtacgaggccctcctcaaggtcaaagaagagctgatgctgctgggcttcatctccctgctgctcaccgtgttccagggcgccacgcagaagatatgcgtgcgggagagcttgatgaaccacctcctgccctgcccgcgcaccaccgccaagaccagcgcgcacttcgtcggcacgaggaggctcctggcaggaggcggcggcgtctccagtgactactgcctcagcaagggcaaggttccaattctttcggtcgatgccattcatcagctacacatatttatcttcgtcttggcagtcacgcatgtggttctcagtgctgttacagttattcttggaatcacgcagactagaaactggaaatattgggaggagaagatccagcaaaacgatgacagtgctcctcaaatgatcaagcatgtgcaagaattcaaatttatcaaaagccacttcagaggccatggaaaacgatgggggatattcggttggctgcgctcttttttcaaacaattctacgggtcagtcacggaggaggactacaccaccctgcgacttggcttcgtcatgaaacactgccggggccatccaaaattcaacttctacaactatatggacagagcattcgaaggggatttcaagaaagtcgttggcataagctggtacctttggggtatgctaatgatattcttgctacttaatgttcacggatggtacgtctacatttggatatcagtaatcccattcattctgttacttgtgctcggaagtaagatggagcatattatcacggagttggctcttgaggttatccaaaagcatacggcaatagaaggggttctagttgtaactccttcggatgaactcttttggttccaccggcctaaactagtccttctcttgattcatatcatcttgttccagaatgcatttgagattgcattcttcttttggttgctggtaacatatgggtttaattcgtgcattatgggaaaaccggcatatgttattactcgtgtggtgataagtgtcatcagccaagtcctatgtggatatagcaccctacctctctatgctctcatctctcaaatgggaagttctttcaagaaggccattttcgatgaaaatgtctccgaaggtctcatcaattgggcagaaaatgctaggaggcgtaatagaatgccaacaagtgttggtgacaattcacctgttggtgaaggaattcaaatgtcaaatcagacacaaagagaatcatcaatggaacagggaactgcaaggttgatctaagtgaaaatatgaatgtacatgctaaca

SEQ ID NO: 417 - DNA, 737 bp, Saccharum officinarum
agtagggtagctgctcttggtctgtagttgcaccagcagcgcaaaaacacgtcacagtttctttctttcccatcaccacatgcattcggagcacgtaaatcggctgcgggcgaccggcgacgacgcgatgtccaagcaaaagactgtgatcaggttgggcgtgccgaacgccaagaaccggtctaaagccatgcagctggcgtccaaatttgtcggagtgaactcggtggcgatcaccggcgaagccaaggaccggctggaggtggtaggagaaagcgtcgacatcccctgcctgatcaactgcctgcgcaagaaggtctgccgcgccgacatcgttctggtggaggaagtgaaggacaagaagaaggaggaggaggagaagaagaagaaggaagaagaagccaagaagaagaaggcggaagaagataagaagaaggcggaagaagagctcaagaagctctgggcggcatgcccgccgccgtactccggtggttattaccgcgggccgccgccgacgacgtttgtgtgcgaggaacagccagcaggctgccacatcatgtgatctgaagcctacttaggatggattttgcccggcgtgtatgcttataatatgtttgtgtttttggttttgaacttttgccaacgtcgtcggcttctctccgtgagccgtgctgtgcgcatgtgcacaaacgtgggtctggtttgcctttggcttcttcagtgatcacgaaaattat

SEQ ID NO: 418 - DNA, 5451 bp, Zea mays
gaatagccttatattattaaaataggctacatctcggagaggtccgtcaatgaaagcggcatagtataccagtctccagaaccttaaacaagagtatacaaaaaaatggagagggctagtcaagaacgtcacaactcacaaaccgaagtacagaagccacgaatttcctcgagttgagtgttgagtcgtctcgtctcgtcttatgtgaaccgagtcaaccgacccaatccccatcgacggatcccccaacgagttccgacttccgttccactagcagtctgcactcggcagtcggccagtcgcacagccagagagccaacaagcccgcagggccgccgcaggcacacgggatggcgctcccatggtggctcaccaccaaggcgtgcacagcgccgccgcctggccccggctccttctccgatgcggtcgcgttcctcttcctctccccgtgcccgcagcgcgggctcctcgccaccgccgacctcgtgttcctcgtcgcctgcatcgtccgcctcgccagacgccttcgcaggggacacccggtgcccgcggctgctccccctcccgagcgcgaggcgctgctgcagaagccgaaccatccttcgccgccgctcgtccgccacgtgctcgcgctcggggcctccgcggtgttcgcggcggtgtccgtcgtcctcctcgcgctcgcgctcctcctcctgccggccacgccgtggcgcgccgcggagggagccttcctctccgtccacgccgtcgcgcacggggtggctgcctggaccatcgtctcttcgcggagagcaggagctgccccggaggcgcacctccgcgtgttctggctcgccaccgctctcggcgccgcgctcttctctgcctcggcagtggtccgcggcgcggacgcctcgctgctcttccccgatgacattctcgccttcgctggtctgcttgtctccctgcctctggcatacatagcggtcaccggcttcaccggcaatgtcaccagggcacaagaaggtgaaccggaacacgccggtccagaggcgccctcctcgccgtacaccaccgcttcgttcctttcgcgcgctacgttcagctggataaactccctcatcaccaagggctacgcggccgaatccctcaaaaccgaagacgtgcccccggtctctgccgcccaccgcgccgaggcggcgcacgccttgttcatgtccaattggccagcgtcgccagcatctcggcacccggtcggcgtggcactctggctctctttctggccgcagctcgtgcttactgcgttccttggcctcgctcgtctgggggccatgtacgttgggccgtcgctcatcgatcagttcgtcgagttcatccgccgcggcgggacatcatgggagggccttcgtctcgttctcatcttgctcgctggcaaggccgtccagacgctggcatcgcaccattacagcttccagggacagcttctgggcatgcgcatccgcggcgcgctgcagacggcgctgtaccgcaagtcgctgcgcctcaccgccggtgctcgccgagcgcacggcgctggagccatcgtcaactacatgcaggtcgacgctgggatcgtgtcctacgccatgcacggactccacgggctgtggctgatgccgctgcagatagtggtggcgctactcctcctgtacgcctacctcgggccccgccgtgctcatgacgctcgccgtgatcaccgcagtgactgtggtcacggccttcgctaacaagctcaacctggcgtaccagctcaagttcctcggcgtccgcgatagccgcgtgaaggcccatcaccgagatgctcagtaacatgcgtcccatcaagctgcaggcttgggaggacaccttcgggggcaaggttcgcgacatccggcgagaagagctcgggtggctggccaagatcatgctcttcatgtgcgccaacacggtggtattctcgagcggtccgctcgctatgacggtgctcgtgttcgggacctacctcgcctccggtgggcagctcgacgccggcaaggtgttcacggccacggcgttcttcggcatgctggaaggccccatgcggaacttcccgcagactattgtcatgtccatgcaggcgtttgtgtcgctggatcggctgaacaaattcctgacggacaccgagatcgacaccgcggccgtggagcgcatcgagagtggcggcgctgaggacacagtggccgtcaaggtgcaaggcggggtgttcgcttgggatgtgccagcggacgaggagatgaagggcaacaacaacaacagcagcaggccccgccatgaggtggcagagaatgaccaaggaaatcgggcggagttggtgacagtgctgaggggcattgacgtggaggtgaggaggggcgagcttacggcggtggtcgggacagtgggctccggcaaatcgtcgctgctgtcctgcatcatgggggagatgcacaagctctccggcacggttagcatatgtggaagcacggcatatgttgctcagactgcttggatccggaatggaaccattcaagagaacattttatttggaaagccaatgcattcagagagatattcggaaatcgtaaatgcttgctgcctggaaaaggatttggaaatgatggagtttggtgaccagactgaaataggagagcgagggatcaatctcagtggaggccagaaacagcgcatccagcttgcaagagcggtttatcaagactgcgatatatatcttctcgatgacatatttagcgcggttgatgctcatactggatcagctattttcaaggaatgtctgaaaggcatactcaagaataagactgtgttgcttgtgactcaccaagtggacttcttgcaaaatgtggatactataattgtaatgaaagatgggttagtcatccagtcagggatctatcttgagttactagcatcatgctcagaattttctgatcttgttacagctcatcatagttcaatggagacagcaggggcacaagcttttcatgttcagaacacagagagctctcaggcttccactggatctgtagatgccccatctttggcatcgaaatccaatgctgaaaatggtgaatcagttggcagtgcaacaaacaaagaagcaggttcttctaagctgatccaggaagaggaaaaggagagtggccgagtaagctggcgtgtgtacaagctatatatgacagaggcctggggatggtggggaattgtggtcattttagctgtgtcactgctgtcagagggctccagtatggctagcaactactggttatcatatgagacatcaggaggccctgtgtttgacacttccttatttcttggtgtttatgcttcgatagttgctacgacaattatattggaaatgatcgccactcttattgtgacattcatggggcttcaatcagcacaggcctttttcaacaagatgtttgacagcattttacgagcgccaatgtcattttttgacaccactccttcaggaaggatcctaagccgggcatcatcagaccaatctaagattgatactaaccttgtgttctatgttggttttgccacatcaatgtgcatctcagtggttaccaacgtcgctattacttgccaagttgcatggccatcagtaattgcagtatttcctctgctgcttttgaacatctggtatcggaaccgttacattacgacatctcgagagcttacccggcttcaaggggtaacaagggcgccaattattgatcactttacagaaagctttctgggtgccccaactgtaaggtgcttcagaaaggaggatgagttctaccagataaacctggacaggatcaattcgaatctgcgtatgtcatttcataattatgcagctaatgagtggcttggatttcgcctggagctaattggcacacttattttgtctataactgcttttctcatgatcagcttgcctagcaatttcatcaagaaagaatttgtcggcatgtccctttcctacggcatttctctcaattccttggtgtactacacaatttccataagctgtatgatcgagaatgatatggtagccatagagagggtgcatcagtacagtactctcccttctgaggcagcatgggaagttgccgacggtcttccctcacaagattggcccagccgaggagacattgatgtgaaagatctgaaggttcggtatcgtcaaaacacgcctctaatcttgaaaggcattactgtgagcatcaaaggtggagaaaaggttggagttgtgggaaggactggcagtggaaagtcgactttggtgcaggctttattcaggatcgtggagcctgcagatggccatatcatcatcgatggtgtcaacatctgcactctggggcttcgtgatctgaggtctcgcttcggtgtgattccccaagaacctgtgctcttcgaaggaactgtacggagcaacatagacccagcagggcggtattccgaggctgagatatggcaggccctcgagtgctgccagctaaaggatatagtagcctcaaaaccagagaagcttgatgcactagtcgccgacatgggggagaactggagcgtagggcagaagcagcttctgtgcttcggccgagtcatactgaaacgcagccggatcctcttcatggacgaggcaacggcttcggtcgattctcaaacagacgcggctatccaaaagatcatccgcgaggagttcgctgaatgtaccgtcatcagcgttgcacatcggatcccgactgtcatggacagtgaccgagtcctggtgttggacgcaggtctagtggcagaattcgacgcaccctccaagttgatgcggaggccatcactctttggtgcgatggttcaggagtacgcaagtcgctcatctagcgtgaaggaaaccgttggatgagatgagaccacttctcatggccaaaagacgacggtatcggagaaatttaggcatacgcatgatgggctctgttcgcaaggaaaaataaattgcactaggactttctgtaagcttgcaagcataaagctttgttttgttcgctacaccatgtattatcttaaatagaactggactatttggtttgcatttccgccaattttgtatgtgacgaaagcttagagcatctacaggaagtttgtgtaattcacatgctaaaccagtgactttcctaagttaagaaaacctaaatttatctctctctggctaatagttttatatgaacttccgtaaaataaaaaaaaggacattatattgttttgtgcggcagggtctgcacggtgtcctaaatttgtcataacgctttactacaactacaatatccctaaaagactcattgatatagataaaattggactagaatgttacattcaccaacatgcaaaaaaaaaaagctacaagtgctataccaacaaataatccaaaag

SEQ ID NO: 419 - DNA, 4953 bp, Setaria italica
gcactcgccgccgaggcagcacaagggatgatggcgctcccctggtggctcgccaccacggcgtgcgctgcgccgccgcccggccacggctcccttgccgacttgctcgcgttcgtgctcctctccccgtgcccgcagcgcgcgctcgtcggcgccgtcgacctcgtgttcctcgccgcatgcctcgtactcctcgcccgccgcccccgcagtggaggaggctcggctgtggcggcagcggctcctcccgaacgcgaggcgctgctgcagaagccgagtcatcacccttcgccgccgcccttccgctacgtggtctcgctcggggcctccgcggtcttggcggcggcgtcagtcgtcctcctcgcgctcgcgatcctgctcctgccgagtacgccgtggcgcgccgcggaggcagccttcctctccgtccacgccgtcgcgcacggagcggccgcgtggaccgtcgccacgtcgcggagagcaggagctgcccaaggcgcgcaccaggcccacctccgcgtgttctggctcgccaccgcgctcggcgctgtgctcttctcggcctcagcggttgtccgcggcgccgacggctcgctgatcttcccggacgatgttctcgccttcgccggcctgctcgtctcgctgccactggcatacgtagcggccactggcttcaccggccatggcaccggcgcgggagactgtgaaccagagcacgccggcgaggaggcgcctgcgtcgccctacgtcgccgcgtcgttcctctcgcgcgcgacgttcagctggatcatctccctcatcaacaaggcctacgcagccgagtcactcatcgccgacgacgtgccaccggtgccccccggcctccgcgccgaggccgctcacgacctgttcatgtccaactggccggcgtcgccggcgtcgcggcacccggtgggcgtcgcgctgtggctgtctttctggccgcggctcgtgcttaccgcgtttctcggccttgcgcgcctcgcggccatgtacgtcggcccgtcgctcatcgaccagttcgtcgagttcatccgccgcggcgggacgccatgggagggcctccggctcgtcctcatcctgctcgtcggcaaggcggtccagacgcttgcgtcgcaccactacaacttccagggccagctcctgggcatgcgcatccgcggcgcgctgcagacggcgctctaccgcaagtcgctgcgcctcaccgccggcgcccgcagagcgcacggcgccggctccatcgtcaactacatacaggtggacgccgggatcgtctcgttcgccatgcacgggctccacggcctgtggctgatgccgctgcagatcgtggtggctctgctgctcctctacacctacctcggtcccgccgtgctcatgacgctcgccgtgatcaccgcggtgaccgtgatcaccgcgttcgccaacaagttcaacctgtcgtaccagctcaagttccttggcgtccgggacagccgagtcaaggccatcaccgagatgctcaaccacatgcgcgtcatcaagctgcaggcgtgggaggatacattcggtggcaaggtccgcgacatccggcgggacgagctcgggtggctcgccaagatcatgctcttcatgtgcgccaacacggtggtgttctcgagcggcccgctcgccatgacggtgctcgtgttcgggacctacatcgcctccggcgggcagctcgacgccggcaaggtgttcacggccacggcgttcttccgcatgctggaaggccccatgcagaactttccccaaacgatcgtcatgtccatgcaggcgttcgtgtcgctcggcaggctgaacaagttcctgacggacgccgagatcgacacgacggccgtggagcgcgtcgagagcggcggcgctgaggacacgccggtggccgtcgaggtgcaaggcggcgtgtttgcgtgggacgtgccggcaagcgaggagatgaggagcagcgacagccaggcccgccttggcgtggaagagaatggccaaggaaatgggtcggcggagttggtgacagtactgaaggggattgatgttgaggtgaggaggggtgagctcacggcggtggtcgggacggtgggctctggcaagtcatcgctgctgtcgtgcatcatgggagagatgcacaaggtctccggcaaggttagcatatttggaagcacagcatatgttgcccagaccgcttggatccgaaatggaaccattcaagagaacattttatttggaaagccaatgcaccttgagagatattcagaaatcatacatgcttgctgcctggaaaaggatttggaaatgatggagtttggtgaccagactgaaataggtgagcgagggatcaatctcagcgggggtcagaagcaacgcattcagcttgcaagagcagtttatcaagattgcgatatatatcttcttgatgacatctttagtgcagttgatgctcatactggatcaactattttcatggaatgtctgaaaggcatgctcaagaataagaccgtgttgcttgtgactcaccaaatggacttcttgcaaaatgtggatactataattgtaatgaaagatgggttagtcatccagtcagggatctatggtgagttattagcatcgtgccctgatttttcagatcttgttgctgctcatcatagttccatggagacaacaggggaacaaggttgccatgttcagaacacagagagctctcaggcttccacaggatctgtagatgtcccatctatcaactcgaaatccaatgacgaaaatggtgaaacaactggcactgcgataaacaaagaagcaggttcttctaagttgatcaaggaagaggaaaaggagagtggccgagtaagctggcgtgtgtacaagctatacatgacacaggcttggggatggtggggagttgtggtcattttagttgtgacactactgtcagagggctccagtatggctagtaactactggctgtcatatgaaacatcaggtggccctgtatttgacactaccatatttcttggtgtttatgcttcaatagttgctactacgattatattggaaatgatcaccactattattgtaacattcttggggcttcaatcagcacaggcctttttcaacaagatgtttgacagcattctaagagctccaatgtcattttttgacaccactccttcaggaaggatcctaagccgggcatcatcggaccaatcaaaaattgatacttcccttgtgttctatgttgggtttgccacatcaatgtgcatttctgtggttaccaacattgctgttacttgccaagttgcatggccgtcagtcatagcagtgcttcctctactgcttttgaacatctggtatcggaatcgttatattgcaacatcccgagagcttactcgtcttcaaggagtaacaagggcgccgattattgatcactttacagaaacctttttgggtgccccaactgtaaggtgcttccgaaaggaggacgagttctaccagacaaacctggacaggatcaattcgaatttgcgcatgtctttccataattatgcagctaatgagtggcttggatttcgcctggagctaattggcacacttatattgtctataaccgcttttctcatgatcagtttgcctagcaatttcatcaagaaagaatttgtcggcatgtccctttcctatggcctttctcttaactccttagtatactacacaatttccataagctgtatgatcgaaaatgatatggtagctgtagagagggtgcatcagtatagtaccctcccttctgaggcagcatgggaggttgcagattgtcttccctcatcaaattggcccagccgaggagatattgatgtgaaagatctgaaggttcggtatcgtcaaaatacacctttaatcttgaaaggtattactgtaagtattaagaatggggaaaagattggagttgtgggaaggactggcagcggcaagtcgactttagtccaggctttattcaggattgtggagcctgcagaaggccgaatcatcatcgatggtgttgatatctgcactttggggcttcatgatctaaggtctcgctttggtgtgattccccaagaacctgtgctctttgaaggaactgtaagaagcaacatagacccaactgggcagtattctgaggctgaaatatggcaggccctcgagcgttgccagttaaaggatatagtagcttcaaaaccagagaagcttgatgcactagttgccgacatgggggagaactggagtgtagggcagaagcagctcctctgctttggccgtgttatactgaaacgcagccggatcctcttcatggatgaggcaacagcttcggttgattctcaaacagatgcagctatccagaggatcatccgagaggaattcgccgaatgcaccgtcatcagcattgcccaccgtataccgactgtaatggacagcgaccgagttctggtgttggatgcagggctagtggctgagtttgacgcaccctccaagctgatggggaggccgtcactctttggtgccatggttaaggagtacgcaagtcgttcttccagctcgaaggaaacggatggatgagagagaccatgtcgacccggcaaagacagcagtataggagaaatttaggcacattagcatacacagcatctaacgaaaggaaaaataaactgtagtaggagtaagcttgcaagcacaaagcgttgtatttccctgttgccactaaatgagcaaattacatgtcgcagcatgtcttatcttacatagaactgcacaatttggttaacactcgaagtcttgaacacttccgtttccctccattttttgtatctgatgaatgcttggtcggaggcatccatgaaggatcaaaaacagctggatagttggggaaaaaaaatatgatgttgctattgtcat

SEQ ID NO: 420 - DNA, 1243 bp, Saccharum officinarum
cccaaaccaaaaccaggataccacgctacaccagcgcttttgccgtcgctcgctgcgtcctgcctactctccttcaccagtgagtcgcaaggtttgttgctagcactcgatcgacaatgtgtggcggagccatcatcgccgacttcgtccccgccgacgcccgtcgcccggcaaccgacgacaccatctccgcctccctcctctctggcgaggaccatctggaggagctgccgccggccaggctgccgttgccggggcgcaagacggcgtaccgcgggatccggcgccgtccctggggccgctgggcggcggagatccgcgacccgcggaagggcgcgcgcgtctggctcggcacctacgccaccccggaggacgccgcgcgcgcctacgacgccgcggcacgcgagatccgcgggcccaaggccaagctcaacttcccgcctgccgtgggcgccggcggcgcgcgcgagccggcggccaagaggcgccgcaagtccgcggcggcggccgaggagagctcgggctcgtctccggcggcggcgacgaccgtcgtggtggcgggcgggagcggcggcggaggaggaggggagacccttcgtgactgcatgtccgggctggaggccttcctggggctgcaggaggaagccgaggcggccgacgagggtggcgacgtggaggcgtgggacgccgtggacctcatgttcgcgtaggccgtagtagtggggcgctcagcgcgcgcgtgccgtcgctgtgaacgggcgccgcgggccgcgctgcagctgctgttttggatcgaccaatattataatgtttcttcaagcagttaagataatttggagacatcctgggtggtgctaagctattactagtactaaaccagagtgattaggagctcccggctctgctaattgcccgtagccgatagcctattctagtagaacgtgttacatgcatgcaacatgtctcatatgcttcggttcatgttcgtaggtactgtatgggaatctcattcagatgcttctgccgaaactcagctggctgttgttgccgatataaagatcagtacgagttcgatttcgtttggcggcacggcaacgatgccgaatttgcagtccaaccatttcagggtgtgtttagttcgtgaaaatttttggctttggctattgtagtatttttgtttgtatttgtcaattagtgtcttcgcatttatcaattagtgtttaattataaaataattagtttt

SEQ ID NO: 421 - DNA, 660 bp, Saccharum officinarum
cacccagcagaaactaaacttgcattgatcgctcatcagctgatctctctaactagctagctacctagcttacttgtagatcgatcggcatcggcaatggctgatgaggagaagaagcaccaccaccacctgttccaccgccacaaggacggcgaggaggaggccagcacaggcgaggtggactacgagaagaaggagaagcaccacaagcacctggagcagctaggcgggctcggcgccatcgccgccggcgcatacgcaattcacgagaagcacaaggcgaagaaggaccccgagaacgcgcacgggcacaaggtgaaggaggaggtggcggcggtggcggccgtgggcgcggccgggttcgcgttccacgagcatcaccagaagaaggacgccaagaagcagggccagagctgagctaggcaaggcagctgcctcgatcctgtgatcgtggtacatatcgtcgcgtctgccgcttatatattgtggcgttaaatgcttaagttgcgtcgtctttgttgcttgccagtgttgagtacttacacatgtccgtgtgtcagggaacgaactggcactagtttcctgcgtgcaggccgtactattgtgcccgatctgtatccactgtttgggcccaccaaaataatgaagtacgtacctgtt

SEQ ID NO: 422 - DNA, 499 bp, Zea mays
cagcagagaaactaaacttgcatcgatcgctcgctcgtcagttctttctgatcatcggtcgcctctctagctagctagctacctgatcggccatggctgaggagaagaagcaccaccacctgttccaccgccacaaggacggcggcgaggaggaggcgagcgccggcggcgaggtggactacgacaagaaggagaagcaccacaagcacctggggcagctcggcgggctcggcgccatcgccgccggtgcatacgcaattcacgagaagcacaaggcgaagaaggaccccgagaacgcgcacggccacaaggtgaaggaggaggtggcggcggtggcggctctgggcgcggccgggttcgcgttccacgagcaccaccagaagaaggacgccaagaagcagggccagagctgatcgagcctctgtctgtgtgtgtgccgcttattattgtggcgtttatagatacttactacttaataaatcgcctcgtccatgttgcc

SEQ ID NO: 423 - DNA, 502 bp, Triticum aestivum
ctaaacttgcatcgatcgctcgctcgtcagttctttctgatcatcggtcgcctctctagctagctagctacctgatcggccatggctgaggagaagaagcaccaccacctgttccaccgccacaaggacggcggcgaggaggaggcgagcgccggcggcgaggtggactacgacaagaaggagaagcaccacaagcacctggggcagctcggcgggctcggcgccatcgccgccggtgcatacgcaattcacgagaagcacaaggcgaagaaggaccccgagaacgcgcacggccacaaggtgaaggaggaggtggcggcggtggcggctctgggcgcggccgggttcgcgttccacgagcaacaccagaagaaggacgccaagaagcaaggccagagctgatcgagcctctctctgtgtgtgtgccgcttaataatgtggcgtttatagatacttactactaataaatcgcctcgtccatgtgcctgccaaaaaaaaaaaa

SEQ ID NO: 424 - DNA, 780 bp, Setaria italica
gtggtatttgactggctagtgggggtggtgttattggaagagcagacggagggttcgtttcgtcctataaataccggtggtttcccgattcatatccatcgccacaaccaaagacaccatcgaaaggtcttacagctgtcatcactagtttctcgacgaccggccatggctgaggagaagaagcaccaccacctgttccaccgacacagcaaggacgacggcgaggaggaggcgagcgccggcgaggtggactacgagaagaaggagaagcaccacaagcacctggagcagctcggcgggctcggcgccatcgccgccggcgcctacgccattcacgagaagcacaaggcgaagaaggaccccgagaacgcgcacgggcaccgggtgaaggaggaggcggcggcggtggcggcgctgggcgctgccggcttcgcgttccacgagcaccaccagaagaaggacgccaagaagcacgccgctgacaactgaccgatgatgatgatgatgatgagctataaataaattcatataggcgcctgcttgcctgcttcgccattgcttgttctgcttttcgcgattgtgagattggttcgtcgtcgtcctttttgttccttgtacgcgccagagccatggacgacgttctggcactggtttcctgcgtgccagatcgccttgggctcgaccgatccgtattcctaaaataactgtgtctgtttcctctgcacagatgtgtaatatatgtattactaaaatacatgtctagttcttacttatttggta

SEQ ID NO: 425 - DNA, 1487 bp, Panicum virgatum
atcaccacacgaagctcgatcgaccggctttccagtttcagttcccccgtagagaggtaaacaggcagctgatcatcaacacccggagaccggcggcgatggccgacgagaagaagcaccaccacctgttccaccgccacaaggacggcgaggaggaggccggcgaggtggactacgagaagaaggagaagcaccacaagcacctggagcagctcggcgggctcggcgccatcgccgccggcgcatacgccatccacgagaagcacaaggcgaagaaggaccccgagaacgcgcacgggcacaaagtgaaggaggaggtggcggcggtggcggcgctgggcgcggcggggttcgcgttccacgagcaccaccagaagaaggacgccaagaagcacgctgctgacgacaactgatagatgacgacggggtgggcctggcatgcctgcctgcggcctgcttcgccacttgtcttgtcgtgctttgtggttgcgagattattgttgtttcgtcgcagttcttctcttcttccgccttgtgctcgatggatccgtagatgtaccatgcgtatccgtaaaataactgtgcttttcatgtcagattgctcctcgcggcagctccgatccctgcgtgtgtaatataatagtatttttttcgacgaatgctcgtgtgatatagaagtatctcttctctatctcttttttactattaaaataattaaaagtgatgtttttctgatttccacgtgcgatcttcaacgcccgcccgcaaatctcgccgcgcacatcgcccgccagcttctcccaccgctcgcacgacctccgctcgctcgcacgcccgcaggccggccaccgccgccgccgcaggccgcgccagctagcgattaaggagcaaagggtggcaaaatttttcgtctttcgtccggcaccgtcgtacgtcgccgctcttgacgacccttcctccgcggctccgcggcggacgtcgccccccacccaactccccgtttcaaggaccagtaatctcgcacccttttcaccgcgccgtctgcgccgccgccggtgtcgccgatccgtgccgccgctccgcgcgcggaccttccgtacctcgccgccgctccatcccggccgcctgccgtccctgccgctccatccgtgtagcactggcttccgttcgttcccctcacctccggtcatccattcccctcccctatcgaccatcgacctgccaccgcctgccaggcaccatggcccccgcacggatgagtacctccaggagtccaggttattctctgattcatgacgcccgtatatttgtaaccaatcgcccgacatgatttttctttttatccccgtgatgaacctgcaacagtccaatagcaaattaagatttcacctgtggatcctctcggccgcgtgacttcacctcagttctacagattgacttcagatcgacgcgtgctcatggatgaatagttggtaattcccctaccg

SEQ ID NO: 426 - DNA, 987 bp, Panicum virgatum
gatactgcagatattggtttgcagaagttttaaaagctctggcaaccgcgcgctgaaaagatcgatgcgatgcgcagcacgattaggacgcctggtttgtccctggtcagtggaacatttaacaatcgcaagtgcagagatggcggtatttgactggacggtggtgatgctattggaagagctgacggagggttcattcgttggttcttgttcccgtctcgtttcgtcctataaataatacccggtagtttcccggttcatatccatcaccacacgaagcttgatcgaccgcggctttccagtttccccctagagattaaacaggcagctaagctgatcatcaacgcccggagacccgcggcgatggctgaggagaagaagcaccaccaccacctgttccaccgccacaaggacggcgaggaggaggggggcgccgccgccggcgaggtggactacgagaagaaggagaagaaccacaagcacctggagcagctcggcgggctcggcgccatcgccgccggcgcatacgccattcacgagaagcacaaggcgaagaaggaccccgagaacgcgcacgggcacaaggtgaaggaggaggtggcggcggtggcggcgctgggcgcggccgggttcgcgttccacgagcaccaccagaagaaggacgccaagaagcacgctgctggcgacaactgatgacgatggggccgagagcctctgctcttgtgcttcgtgattgcgagattattgttgtttcgccgtagttcttctcctcccgccttttgctccatcgatccgtacatgtaccatgcgtatccgtaaaataattgtgcttgtgcgtgcgtgtcagcttgctcctcgcagcagctagctccgatccatgcttgtgtaatacgatacagtatttttttttcccgacgaatgctcgtgtaatatatgaataccaccacactaatacacgcatcgttcttactgcttgtttggtgcctc

SEQ ID NO: 427 - DNA, 1638 bp, Zea mays
ttatgatttcctgcgagcacaaagctagcgaagataccaaacaatggggagcacgagcgccacaggcaccacgtcgtcttcctcatcggctgcccacgggggcggtgccgcacacgtactgctcctgccgtacccgggcgcgcagggccatacaaacccgctgctccagttcggccgctgcctcgcctaccacggcctccgccccacgctcgtcacctcgcggtacgtgctctccaccaccccgcctcccggggagcccttcagggtggccgccatctccgatggcttcgacgacggcggggcggccgcgtgccccgacctcgacgtgtactggcgccagctcgaggccgtcggctcggagacgctggcggagctgatccgctccgaggccgccgatgggcggcctgtgcgcgtgctggtttacgacccgcacctgccgtgggcgcgacgggtggcacaggcggccgggctggcggcagcggcgttcctatcgcagccatgcgccgtcgacgtcgtctacggggaggtgtgggcaggacggctgccactgccggtggtggacgggaaagagctgtttgcacgcgggctgctgggtgtcgagctcggtcccgacgacgttccgccgttcgcagcaaagccagactggtgccctgtgttccttcgggcatcactgcggcaatttgaggggctggaggacgccgacgacgtgctcgtcaactcattccacgagatcgaacccaaggaggcagattatatggccctaacatggcatgcaaagacaataggcccaaccttgccatcattttatcttgatgatgaccgtttgccgttgaacaagacttacggtttcaacctcttcaacagcagcgagtcatgtctggcttggcttgacaaacagcttccgtgttctgttgttcttgtatcctatggtactgtctctgattatgatgaaacacagttagaggagcttggcaatggattgtacaattctggcaaaccattcatttgggttgtgaggtcaaacgaagaacacaagttgtccgatgaacttcgtgacaagtgcaaggaacgtggccttattgtttcttggtgcccccagctggaagttctagcacataaagctacaggttgtttcttcacacattgcggatggaactcgacattggaagcaattgttaatggtgtgccaatggtggcaataccacactgggcagaccagccgaccatatcaaaatatatggagagcatgtggggcttgggtgtccgagtgcgcaaggatgagaaaggcttggtaacgagggacgaggtggaaaggtgcatcaaggatgtcatggatggtgatagtaaggataagtataggaagagtgccactatgtggatgcaaaaggccaagtccgccatgcagaatggagggagctcggacaagaatattacagaattcgtcgcgaagtattctttaagttaattttcaaagatttcgtaaaaaagttatttttcaaaggtataatgatagtgttataattacttcctaccttcgtggattgtatgccttcctgcatgtgatatattttgtctcgggattgtgtgtattacgttttgacttgatgctgtacatgctacagcagcaacctccacgtc

SEQ ID NO: 428 - DNA, 1697 bp, Zea mays
gtgcgaactcaaagctgaagacaacaaaccatggggagcacaagcacgagcgccacctcgtcttcctcctcctctgctgccagcggcgcacacgtgctgctcctgccgtaccctggcgcgcagggccacacgaacccgctgctccagtttggccgccgcctcgcctaccacggcttccgccccacgctcgtcacctcccggtacgtactctccaccacgccgcccccaggggagcccttcagggtggcagccatttccgacggcttcgacggcggcggcgcggccgcgtgccccgacatcgctgagtactatcgccagctcgaggccgtgggttcggagacgctggcggagctgatccggacggaggccgccgagggccggcccgtgcgcgtggtggtttacgacccgcacctgccgtgggcgcgctgggtggcgcaggcggccggggtgccggcggtggcgttcctgtcgcagccgtgctccgttgacgtcatctacggggaggtgtgggcggggcggctgccgctgcccgtggtggacgggaaggagctgttcgcgcgcgggctgctgggtgtcgacctcgggcccgacgacgtgccgccgttcgcggccaggccagactggtgccccgtgttccttcgggcgacggtgcggcagttcgaggggctggaggacgccgacgacgtgctcgtcaactcattccgcgacatcgaacccacggaggcagattatatgtccctaacatggcgcgcgaagacaataggcccaacgttgccatcattttaccttgatgatgaccgctttccgttgaacaaggcctacggattcaacctcttcagcagcagcgactcatgtctgccttggcttgacaagcagcgtccgcgttctgtagttctcgtatcctatggaactgtttcagattacgacgaaaatcagctagaagagcttggcaacgggctgtacagttctggcaaaccattcatttgggttgtgaggtcgaatgaagaacacaagctgtcggatgagcttcgcgacaagtgcaaggagcgcggccttgttgtctcttggtgcccacagctcgaagttcttgcacataaagctacaggctgtttcttcacgcactgtggatggaactcgacactagaagcgattgttaatggcgtgccaatggtggcagtaccacactgggctgaccagccgaccatatcgaaatacatggagagcgtgtggggcttgggtgtcaaggtgcgcaaggatgagaaaggcttggtgacgagagacgaggtggcgaggtgcatcaaggatgtcatggatggggatagaaaagatgagtacaggatgaatgccaatgtgtggatgaaaaaggccaaggaagctgcacagtacggagggagctcggacaagaatattgctgaattcgtcgccaagtattcatcaagttagttgtcaaacagattttttgtgtatctacaagagcctattttcacgacccagaatctgcgtcataagttagcagcctttgaaacgttgtcataagttagtactccaataaaaattacacacacacatatatatatatatatataatactgttatgcaccctttgaaacgttgtaagcatacagaattgcacatttgggactcaacgtagtgcttcacaatattgccatccgaaatatttacttagtaaaaaagag

SEQ ID NO: 429 - DNA, 2337 bp, Zea mays
gcactgcatattcctggattctggtctcgtgtgtactgagacgatggagtgatgaacagtacaatatagcttcaagttttgcctcaaaactacgatttcataaggcatagaatagacttgttcaaacccctgccatatatatgcacctgtttgattgccaaatagctgactaaaaggattactattttctagttacgaaagaaaagcggctggcttgaggatcctttacggcctgtgtatttttgttggcttggagccaggaaagaaaggaagaaaaggcaggacagacaactccatcaaccaaaaaaaacgtgctaacgacaccagtcaacggtcaactcagacttccactttccaagttccaacgaacgagaaaacttgcgcgccacgccgttgtgcctccactgcacaggattaggaacgccttatttatttactccagggccccaggctctcatcgctgcgaagtgccaacccaaagccgaagacagcaaaccatggggtgcacaaccacgagcgccacctcgtcttcctcctctgctgccagcggcggcggtgcacacgtgctgctcccgccgtaccctggcgcgcagggccacacaaacccgctgctccagttcggccgccgcctcgcctaccacggcttccgccccacgcttgtcacctcccggtacgtactctccaccacgccgcccccaggggaacccttcagggtggcagccatctccgacggcttcgacggcggcggcgcggccgcgtgccccgacatcgctgagtactatcgccagctcgaggccgtgggttcggagacgctggcggagctgatccagacggaggccgccgagggccggcccgtgcgcgtggtggtttacgacccgcacctgccgtgggcgcgctgggtggcgcaggcggccggggtggcggcggcggcgttcctgtcgcaaccgtgctccgtcgacgtcatctacggggaggtgtgggcggggcggctgccgctgccgctgccggtggtggacgggaaggagctgttcgcgcgcgggctgctggatgtcgacctcgggcccgacgacgtgccgccgttcgcggccaggccagactggtgccccgtgttccttcgggcgacggtgcggcagttcgaggggctggaggacgccgacgacgtgctcgtaaactcattccgcgacatcgaacccaaggaggcagattatatgtccctaacatggcgcgcgaagacaataggcccaacgttgccatcattttaccttgacgatgaccgcttgccgttgaacaaggcctacgggttcaacctcttcagcagcagcgactcatgtctgccttggcttgacaagcagcgtccgcgttctgtagtcctggtatcctatggaactgtttcagattacgacgaaacgcagctagaagagcttggcaacgggctgtacagttctggcaaaccattcatttgggttgtgaggtcgaatgaagaacacaagctgtccgatgagcttcgcgacaagtgcaaggagcgcggccttgttgtctcttggtgcccacagctcgaagttctagcacataaagctacaggttgtttctacacgcactgtggatggaactcgacactggaagcgattgttaatggcgtgccaatggtggcagtaccacactgggctgaccagccgaccatatcgaaatacatggagagcgtgtgggccttgggtgtcaaggtgcgcaaggatgagaacggcttggtgacgagagacgaggtggagaggtgcatcaaggatgtcatggatggggatagaaaagatgagtacaggatgaatgccactgtgtggatgaaaaaggccaaggaagctgcacagtacggagggagctcggacaagaatattgttgaactagttatgtgcccgtgcgttgcgacggcatacaaattattcgatacaaagttagtgtataataattacatgaaaacaatcaatatatattataaacaactacaaacttatctattggcacgaacattaaacatgacatcgatgttttttcaaggcttcacgagacaaaaaaaagatcaattgggaaaaaaggaacataaatgtgagtagacctgagtggtcaatagctgagcaaatatggccttcacatcatcgaagactacatcagcagatttggcgccatcaacctgagcgagcatgcacccgcaaacttttacttaagtgagattaggtcagtcattaccgttcatatttactctacagaataaagttacaaactttaattagcacagtctacgtttcatacaaaaaaatcagagcagccgcaaattattattcttcagag

SEQ ID NO: 430 - DNA, 1736 bp, Setaria italica
tcacagcgacacaagcgaaccaaaccaacaatggagagcacgagcgccagcgccggcgcgcacgtgctcctcatgccgtacccaggagcgcaaggccacaccaacccgctgctcgagttcggccgccgcctcgcgtaccacggcctccgccccacgctcgtctccacgcggtacctgctctccaccatcccgccccctggggagcccatcagcgtggccgccatctccgacggcttcgacgacggcggggctgcctcgtgcccggacctcaatgattacttgcgccagctcgaggccgtcggctcccggacgctggcggagcttctccggtccgaggccgccgagggacggcccgtgcgcgtgctcgtttacgacccgcacctgccgtgggcgcggcgggtggcgaaggcggccggcgtcgcgacggcggcgttcctatcgcaaccgtgctccgtggacgtcgtctacggggaggtgtgggcggggcggctgccgctgccggtgacggacgggagggagctgttcacgcgcggcttgctaggtgtcgagctcgggcctgacgacgtgccgccgttcgcggcgaggccggactggtgcccggcgttccttaaggtctccgtgcggcagttcgaggggctggaggacgccgacgacgtgctcgtgaactcattccacgacatggaacccaaggaggcagattatatggcactaacatggcgcgcaaagacaataggcccaaccttgccatcattttatcttgatgatgaccgtttgccatttaacaagacttatggtttcaacctattcagcagcagtgtgtcatgtctggcttggcttgacaagcagctcccgtgctctgtagtccttgtatcatatgggactgtctccgactatgatgaaacacagttggaagagcttggcaacggattgtgcaattctggaaaaccattcctttgggttgtgaggtcaaatgaagaacacaagttgtcttgtgaactccgtgacaagtgcaaacagcatggcctcattgtttcttggtgcccccagctcgaagtcttagaacataaagccacaggctgctttttcacacactgcggatggaactcaacactggaagcaattgttaatggtgtgccaatggtggcaataccacactgggcagaccagccaaccatatcaaaatacatggagagcgcatggggcttgggcgtccgggtgcgcaaggatgagaaaggcttgctgaggagagacgaggtggaaaggtgcatcaaagaggtcatggatggagataggaaggataagtacaaggcgaatgccactatgtggaagcagaaggccaagaaagctatgcagaaaggagggagctctgacaagaatattgctgaatttgccgcaaagtattcaagttactaattgtcaagatataatgatactgtattaatagttcataattttgtggatgtgtactgtatgttaataattctgtcggtggattgtaagtgctacttgcctgcattaatttgcttgtcatatatacttggaaagtgctctgctctattggatcttccagaccttaaatatgtggattattcgacagccattgaaactgaaagttccttgcacttgaaatgccacaggcttcctgcatgtatggttattcgatttcaacacagagaagaatttaactgcccatagcaactaaattggttgtgcctactgcctagatcaaaacttga

SEQ ID NO: 431 - DNA, 1590 bp, Zea mays
acagctgaaactaacaaatataaacaaaccatggggggcaagaagatccccagcaccacatcgtgttcaccactaccctccactgattctgatcaccggggcatcagtgacgggcacgtcttgctcctgccatacccgggagcgcaaggccacaccaacccgctgctccagtttggccgccgcctcgcctaccacggcctccaccccacgctcgtcactacgcggtacgtgctctccaccacgccgcctcctggtgaaccattcagggtggccgacatctcggacggtttcgacgattgcggcgcggccgcgtgcccggacctctccgagtactggcgccagcttcaggccatcggctcggtgacgctagcagagcttatccggtcggaggcctccgagggtcggcccgtgcgcgtgctggtttacgaccctttcctgccatggtcacggcgggtggcgcaggaggctggggtggcggcggtggcgttcctgtcgcaatcatgcgccgtcgacgtcgtgtacggggaggtgttgtcggggcggctgccgctgccagtggtaaatgggaaggagctctttgcgcgcgggctgctcggtgtcgagctcgggcccgacgacgtgccgccgttcgtggcaaagcctgactggtgccctttgttccttcgggcatcgctgcagcaattcgaggggctggaggacgccgacgacgtgctcgtcaactcattccacgatatcgaacccaaggaggcagattatatggcactaacatggcgtgcaaagacaataggcccaaccttgccatcattttatcttgatgatgaccgttttccgttgaacaagacctatggtttcaacctcttcaacagcagcgagccatgtctggcttggcttgaaagacagcttccgcgttctgttattctcgtatcctacggtactatctctaattatgatgaagcacagttagaagagcttggcaatggattgtacaattctggcaaaccattcatttgggttgtgaggtcaaacgaagaacacaagttgtccgatgaacttcgtgacaagtgcaaggaacgtggccttattgtttcttggtgcccccagcttgaagttctagcacataaagctacaggttgtttcttcacacattgcggatggaactcgacattggaagcaattgttaatggtgtgccaatggtggcaataccacactgggcagaccagccgaccatatcaaaatatatggagagcatgtggggcttgggtgtccgggtgcgcaaggatgagaaaggcatggtaacgagggacgaggtggaaaggtgcatcaaggatgtcatggatggtgatagtaaggataagtataggaagagtgccactatgtggatgcaaaaggccaaggcagctatgcagaatggagggagctcggacaagaatattacagaattcgccgcgaagtactcatcaagtcaaaaaatatagtgccatagaattaataggtgagcaatttgtagtcaatatttgttggaggtatcttctgaaatgtggagcgagccaaaagaaattttatgacggaaccgtccaatttaactagtt

SEQ ID NO: 432 - DNA, 1412 bp, Panicum virgatum
acgccgcagcattcacccaacgcgttcctcattaacattccaaaaccatgggcagcgagagcgccggcgccgcctcgtcttcatccacctcctccaccaccgtccaccacgaggccggcggcgcgcacgtcctgctgctgccgtacccaggggcgcagggccacaccaaccctctgctccagttcggccgccgcctcgcatacctcgggctccgccccacgctcgtctgttcgcggtacgttctctccaccaccccgccaccaggggagcccttcagggtggccgccatctccgacggcttcgacgacggcggggcagcctcgtgccccgacctcagcgagtactcccgccagctgcaggccgtcggctccgagacgctggcggagctgctccggtccgaggcctccgaggggcggcccgtgcgcgtgctggtttacgacccgcacctgtcgtgggcgcgccgggtggcgaaggcggccggcgtggcggccgcagcgttcctgtcgcagccgtgctccgtggatatcgtctacggcgaggtgtgggcggggcggctggagctgcccgtgacggacgggagagagctgttcgcgcgcgggctgctgggagtcgagctcgggcccgacgacgtgccgccgttcgccgcgaggccggactggtgcccggtgttccatgaggcgtccgtcaggcagttcgaggggctggaggaggccgacgacgtgctcgtcaactcattccacgccatcgaacccaaggaggcagattatatggcactgacatggcgtgcaaagacaataggcccatccttgccatcattttatcttgacgatgaccgattgccgttcaacaagacttatggtttcaacctcttcagcagcaacgtgtcatgcctggcttggcttgacaagcagcttccatgctctgtagtccttgtatcgtatgggaccgtatctgattacgacgaagcacagttggaagagcttggcaatgggttgtgcaattctggaaaacccttcctttgggttgtgagggcaaatgaagaacacaagttgtctgatgaactccgtaataagtgcgaacaacatggccttattgtttcttggtgcaaccagttagatgtcctagcacataaagccacaggctgtttcttcacccactgcggatggaactccacattggaagcaattgttaatggtgtgccaatggtggcaataccacactgggcagaccagccaaccatatcaaaatacatggagagtgtgtggggcttgggcgtccgggtgcgcaaggatgagaaaggcttggtaacgagagacgaggtggaaaggtgcattaaggaggttatggatgggggataggaaggataagtacaggacgaatgccaccatgtggatgcaaaaggccaaggaagc

SEQ ID NO: 433 - DNA, 817 bp, Sorghum bicolor
tagcggctataaaagcagcgggacgcagctcaactgctcaagccagctcgcaagtcaccgagagcaatcaacgcaagcagctgagctacttcagacagctttatttgagcagagcagagcagaggatccgaggactcgaggaggaagacacagcttgctaaagagatcgcgcgcgatggcgtccatgatgatgggaggagactttgtggaggcgtacgtgctcaagaacgcgtacaaggagaagctccggcgcatggaggccgccgaggagacgaagaagggcaagctgggctccgcggcggagaagaaggtctcgggcggcggcggcaggggaggaggaggaggaggaggcctgtttgggctcctgaagaagaaggtgcacccaaaagcagcggccgcgtcgcccatggagaccaggagcactgaagaagaagaagaagaagcctcttcttgataaatttgctgtcgccattgccagacgttcggtcggcgcacggattggtggaaaacgcctgcttgcaattactacgacgcaagtagtagtgcttctaggtttgtgtagtcttcgttccttctttctttgttgattgacgatcgatccagcgtgtttctcgcttgatgtcgatcatgttgtttcattggttactcagtgcaagttatattacgtgaaatggcaaaaacggcattggccaagcgcccaagccataagtgataagtccataacttcagctagaatactgttttccctggtgtaatgtaacgcgataattagatacttgtcatattaacgtccaagttatgcagaccttaattctgg

SEQ ID NO: 434 - DNA, 763 bp, Saccharum officinarum
agcctaccacgcgcccgcaagcctgagactgcaggccagttcatggactggggcaaatcgcacgctgagagcgagctcaaacgctgcctatttctttctgcttgcgctgaagacaaccccactccgaccggagcctccgatggctcgtcatcctgcgcctcggccgtcgccctgtcctttctcgggctcaacagcgtgatagccatctaccactcgagacatgatccccgatccatgctatttgtaaccgtctccttcttttgcgtcgtccttctcttccacctgcttcgtgtgttcgagagattgccgccgggatcgcccaggaggttgcaggtgaaggcggccgtatgggccctcaccaccaccctgacggtgatgttctccggcagagttgccccgttgatgcctgcgcctgtcgccgccgtcgtccggtcgatggccgcggtgaccatccttgcgggtttctacttgttcttcgtatgtccggacgccgccttcaccggcgacgagaagccggcctgcaaggttgccgaaagcccgtagatagtttctgtgtgggctccctcggagaatccacgatcgaagtatcatggcctgagatgtggtgtgcaacctggcttttgtatttgttacaaatatatattgtcgggaaaacaaaatacccacccctatctatcccctaacttcgaacctttcccacctatttttgatttcctcgctttctcttgactctgaccttaccattgaccctttccgtggctct

SEQ ID NO: 435 - DNA, 1231 bp, Secale cereale
accacgccccgcacgttgtcagtgcgacgcagctagctgttgtgcactctgcagaggagacgacgcatggcctcgacaacggcggtgccggaggtggcgctgcggtccggcgacgcgaggcccatgccggccatcggcatgggcaccgccaagttcccgatggtgccggagaccaccgtgaaggccgtgctggaggccgtggaggtgggctaccgccacttcgacacggcctccatgtacgcgacggagcggcccctgggcgaggccctcgcggaggcggtgcgccgcgggctcctggcgtcccgggaggaggtgttcgtcacgtccaagctctggtgcacgcagtgccacccgcacctcgtgctcccgtccctccgggagagcctccagaacctgcagatggagtacgtggacctgtacctgatccactggccgatcagcctcaagcccgggccggcggtgttcccggtgaagcgggaggacgccgtcccgttcgacttcgagggcgtgtggcgggcgatggaggagtgccaccgcctcgggctcgccaaggccatcggcgtcagcaacttcaccaccaggcacctcgacaagctcctcactgctgccaccatccctcctgcagtcaaccaggtggagatgaacccggtctggcagcagaggaagctgagggggtactgcgccgagaaaggcatccacgtcgcggcctactcgccgttgggagggcagaactggtcgggcgacggcaacgccgtgctggactccgaggtgctggctgagatcgccaaggctagagggaagaccgtcgcacaggtagcgctgaggtggatctacgagcaaggagcgaccccgatcgtcaagagcttcagcaaggagaggctcaaggagaacctcgggatcttcgactgggggctcaccgacgacgacctgcgcaagatcggccagattccgcagaagaagatcgtcaaagctgcaggcgtgctcttctcggcagagggcgagttcacgtcggctgacctcgcagacatggaaattgtcgaggaataaaattggcactgagaaactgagaatgcctgcttcgctgtgtgacgtaaactgcagtagcttacatacagagtggggatgaataaagaagtgatccgtgctatatccttcctgttattcctctttttcggcccaatactttgattcaagttatcagtgaagattgtgataaccgttgccaaactga

SEQ ID NO: 436 - DNA, 1461 bp, Hordeum vulgare
gtatggcacgagaaattgtctagctcaactatgtccgccgcacaaggaagaagatgatgcctgcctgaagaaacaaaatccacctctttgtctttggaaaacggaagaatagctacgtaagtacttatgtcactccggccagtataaagccggtggctcctcaccggcgcgtcctgtacttgaaccacaagacaggctcgaccacgcgtcagtgcgagtcgacgcagctgttgtgcactccgccgcagagagacgacccatggcctcgacaacggcggtgccggaggtggcgctgcggtccggcgacgcgaggcccatgccggcgatcggcatgggcaccgccaagttcccggtggtgccggagacgaccatgaaggccatgctggaggccgtggagctcggctaccgccacttcgacacggcctccatgtacgcgacggagcggcccctgggcgaggccctcgcggaggcggtgcgccgcgggctcctggcgtccagggaggaggtgttcgtcacgtccaagctctggtgcacgcagtgccacccgcacctcgtgctcccgtcgctccgggagagcctccggaacctgcagatggagtacgtggacctgtacctgatccactggccgatcagcctgaagcccgggccggcggtgttgccggtgaagcgggaggaggccgtcccgttcgacttcgagggcgtgtggcgggggatggaggagtgccaccgactcgggctcgccatggccatcggcgtcagcaacttcaccaccagccacctcaacaagctcctcgccgccgccgccgtccctcctgcagtcaaccaggtggagatgaacccggtgtggcagcagaggaagctgagggactactgcgccgagaagggcatccacatcgcggcctactcgccgctgggagggcagaactggtccggcgacggaagcgccgtgctggactccgaggtgctcgcggagatcgccgggcttagaggaaagaccgtcgcacaggtcgcgctgaggtggatctacgagcaaggggcgaccccgatcgtcaagagcttcagcaaggagaggctcgaggagaacctcgggatcttcgactgggggctcaccgacgacgacctgcgcaagatcgaccagattccgcagaagaagatcgtcacggctgcaggcgtgctgttctgcgcagagggcgagttcacgtcggctgacatcgcagacatggaaattgtcgaggagtagaataggcactgagaattcggatgtatgaggtgaactgcagtagcttacttaaagagtggggtgaatatcggttatatattatgttattcctctttacggattcgagttaattagcagtgaagattgtgatcaccgttgccatcggtcggaagtaccttgtgcagtaagcattttcctccggatggtcagtaaacatggctgtcaatcgttgttacattgcc

SEQ ID NO: 437 - DNA, 3303 bp, Aegilops tauschii
ggcagaggcggcgcggcgcggggtcatagcgtcccgcgaggaggtgttcgtgacgaccaaggtgtggtgcacgcagtgccacccggatctcgtgctcccttccctcaaggaaagcttgcaaaaccttcaaatggaatatgttgatttgtacttggtccactggcctatgagcgtaaagcccagcaaacctcacttcccaatgaaaagggaagacatcgtccagatggacttgaaaggcgtatggcaagcaatggagggatgtcatcgccttggccttgctaaaatgattggtgttagcaatttcacaatgaagaaattgcaggagctacttcaaattgcaaaaatccccccagcagtgaatcaggttgagttgaatccagcttggcagcagaaaaaactgattgaattctgcaaagagagaggaattcatgtgactgcttattctcccctgggaggccaaagcaggacatccaaaatcaatgcagtgctacagtctgaaattctgaaagagattgcggaagctagaggaaagtcagtagctcagatctcactgcgatggatcttcgagcaaggagcgagcatggtagccaagagtatgaaaaaggagaggcttcaggagaacctcgaaatctttgactgggaactgaccgacgaagaccggttaaagattactcggataccgcagtacaagaaggtcacagtgctggcgatcctctgccctgaaggtgaccctagcgtcgatctttcggaggttgatgttgttgaaacgtagatgtcaaattatgaagatgcatgcgccatttaaacctgtaatttggtgaagatgcatgcgccatttatgcactccaaattacaaggatttggtgagatgcttctggtgctactgccctgtaacctatctggatgaggtcctgcttggcatcatcaattgtgatgatcctgacgggttccctacagtgctgatgggtagccttcagccgtcactgacagtgtcacaaatggacctggccacaggccacagccacttcggttggctgatctctccttgtctcgcgccagcatcttctcttctctccaggaaaaatgaaagattacaaattgcacctagaaaatcgacgaaattctgtcaagctcggatggacactagaaggctcttgcttgttcgacaggtaagccaaacttcttgtggcgagcgcgacaacaagtcaacaactgaggcgggtcttggctacgagacggacgtatggcagacatgtgggcctctgagtttttttttgtgcgtgcattgtgcatgcattgtggtggttacttcacaactgcctccgccgcacaaggatcctgtttcattccaaaaacaattgatgcccgccggaagaaccaaaatccacctctctgtctttgaaaaacggacgaacagctacgtaagtccttatgtcactccggccagtataaaagccggtggctcgtcctgtacttgaaccacaagacaagacaagctcaatcactctgcagagacggcgcatggcctcgacaacggcggggccggaggaggcgtggcgcccccccccccccccccccccccccccccccccccccccccccccccccccccccccccccccccccccccccccccccccccccccccccccccccccccccccccccccccccccccccccccccggccatcggcatgggcaccgccaagttaccggtggtgccggagaccacggtgaaggccgtgctggaggccgtggtggtgggctaccgccacttcgacacggcctccatgtacgcgacggagcggcccctgggcgaggccctcgaggaggcggtgcgccgcgggctcctggcgtcccgggaggaggtgttcgtcacgtccaagctctggtgcacgcagtgccacccgcacctcgtgctcccgtccctccgggagagcctccagaacctgcagatggagtacgtggacctgtacctgatccactggccgatcagcctgaagcccgggccggcggttttcccggtgaagcgggaggacgccgtcccgttcgacttcgcgggcgtgtggcgcgcgatggaggagtgccaccgcctcgggctcgccaaggccatcggcgtcagcaacttcaccaccagccacctccacaagctcctcgccgctgccaccgtccctcctgcagtcaaccaggttgctgaacacaacactacgagatcaccgagtagtactggtctgaatattcactgggactcagcgctagctgcgtgtggtgtgcaggtggagatgaacccggtctggcagcagaggaagctgagggagtactgcgccgagaagggcatccacgtcgcggcctactcgccgttgggagggcagaactggtccggcgacggcaacgccgtcctggactccgaggtgctcgcggagatcgccaaggctagaggaaagaccgttgcacaggtagcactgaggtggatttacgagcaaggggcgaccccgatcgtcaagagcttcagcaaggagaggctcaaggagaacctcgggatcttcgactgggggctcaccgacgacgacctgcgcaagatcggccagattccgcagaagaagatcgtcagagctgaaaccgtgctgttctcggcggagggcgagttcacgtcggctgacctcgcggagatggaaattgtcgaggaataatataggcaccgagaatgccttcttcgctgtgtgacgtaaactgcagtagcttgcataaagagtggggatgaataaagaagtgatccgtgctgtatcctgttattcctcttttcggattcaagttgtcagtgaagactgtgatcaccgttgccatccgctcggaagtattccctaatttgaactgcaaaaacggcttatattagtgtactactccctccatttcaaaataaatgactagtacaaagttggatcatctattttgaaacggaaagtgctgcaaccgaagttccatacggcgcaaggttttcctctagatggtcagtaaaaatgactgtcaatcgttgtttcattgcccatcgacacctgtcgaacgttgctttctggcgtgctccaattcggggtggatggacagctttcgctgcagcacgtctaatgtcatgtacccactaatctcacacagcgaccggatctattctagtcgaatcctcaagtgtcggggtgtcttttcccgtcaaacccgttgtattttgacttggcgaattacggcttcattttccacgtaaaaatcatttgaaaacttggtgaaataggaaaaaggttcaatcacagcc

SEQ ID NO: 438 - DNA, 1142 bp, Brachypodium distachyon
gttgtcacgcgcattttgtgcaccgcgaccacaagacgagtataccacaaaaaactgcatggcttcggtgccggaggtgaccctgcggtccggcaacgcgaggcccatgccggcgatcggcatgggcacggccaagttcccggtcgtgccggagaccaccagggacgccgtgctggcggccgtggagctcggcttccgccacttcgacacggcctccatgtactcgacggagaagccgctcggcgaggccatcgcggaggcggtgcggcgcgggctcgtggcgtcccggggggaggtgttcgtcacgtccaagctgtggtgcacgcagtgccacccgcacctcgtgctcccctccctccgggaaagcctccagaacctccaaatggagtacgtggacctgtacctaatccactggccgatcagcctgaagccggcgccaccggtgttcccggccaagccggaggacgccgtcccgttcgacttcgaaggcgtgtggcgggcgatggaggagtgccagcgcctcgggctcgccaaggccatcggcgtcagcaacttcaccaccaaacacctcgacaagctcctggccactgccaccgtgccccccgcggtgaaccaggtagagatgaacccggcctggcagcagcggacgctgaggaagtactgtgcggagaagggcatccacgtcgcggcgtactcgccgttgggagggcagaactggaccggggaaggcaacgccgtgatggattccgaggtgctcgcggagattgcccaagctagaggaaagagcgtcgcgcaggtagcactgaggtggatctacgagcaaggagtgaccccaatcgtgaagagcttcagcaaggagaggctcaaggaaaaccttgagatcttcgactgggcgctgacggacgacgacctgctcaagatcagccagaacccacagaagaaggttgtcaaagctataggcatactgttcccgacagagggcgagttcacgtcagttgacccttcagacatcgatatcgtcgaggaataggcgctgtggctcgccctgagaccgctttcttcaccgtttgatgtaaactacacagatcttagaaacttggaataaataaagctcgttcagccagcgttatgctgtttttaaa

SEQ ID NO: 439 - DNA, 1069 bp, Avena sativa
tgaccggtgttggcagagagagacgacacatgtcttcgacaacaactgtaatggtgccggaggtggcgctgaggcatggcaacgcgaggcccatgccggcgatcggcatgggcacggccaacttcccggtggtgcacgagaccatcagagacgccgtggtcgcggccgcggagctgggcttccgccactttgacacggcctccatgtacgggacggagccgccgctgggcgacgccctcgcggaggcgctgcggcgcgggctggtggcgtcccgggaggaggtgttcgtcaccaccaagctctggtgcacccagtgccagccgcacctcgtgatcccgtcgctccggcaaagcctccagaacctgcagctggagtacgtagacctgtacctgatccactggccggtcagctgaagcccggaccaatggtgttcccggccaagcgggaggacgccgtgccgttcgacttcgagggcgtgtggcgggagatggaggagtgccaccgcctcggcctcgccaaggccatcggcgtcagcaacttcaccaccgcgcacctcgacaagatcatggcgactgccactgtcccgcctgctgtcaatcaggtggagatgaacccggtctggcagcagaggaagctgagggagtactgtgcggagaagggcatccacgtcacggcgtactcgccgttgggtgggcagaactggtccggagagggcaacgccgtgatggattctgaggtgctcgcggagattgccaaggctagagggaagagcttggcacaggtagcactgaggtggatttacgagcaaggagtgaccccgatcgtcaagagcttcagcaaggagaggctcaagcagaaccttgagatcttcgactgggagctcaccgacgacgaccggctcaagatcagccagattacgcagaagagatggtcacggttaaaggatttttctcgtctgaaggcgagttcgactcggttgaccttgcagacatggaaattgtcgaggcataggtcgtgtgacaaagttcgcaggaaacttgtgtacactagcttaatataatgtgggaat

SEQ ID NO: 440 - DNA, 1189 bp, Aegilops tauschii
aagttggcgaccgatcgacgaagcatctttgcattgcaccctcaccccggcagaggtcaaagcggcgtctcacctttatataggcgcgcagcccacaccccgacctcccaaacacagcaagcaagcaacatatcctggttagaaccgagtctcagggaagaaacttggtgaattttcgcgggtgtcgtgtgatcaaagctcgggagtcggaatggagttcgagatggcgagccagcacggggcgctgctgaaggtggggctgttcgtgctggtgcaggcgctggtgtacctcatcctcgcccagtcctcctccgtcttctccaccaccaagaccctcggcctcccgccggcgcgctccctcagcgcccgccgcatggtcgcactgctctccgacctgccgctcggcggcgaaccctcgccccgcgccgtctccgtggagccgtcgtcgcccgtgcccgtgcacgcccaccagaagaaggattagttgacagagctgggaggtggctactgtctagcgagcgagcgtatgcacgttgttggttccgtgccaatggttggtgcctgccgtgggagtttgctagctattcacgccattctttggtggttcattgattggtcggtttgttctttgagattgcatatatgtaaactgcacgccgttttggattgtacaaatgaccgtctaagattgtgcttcggttacagtgcagtcgtgcttctgttttgagtggagacttgtgatgaacagagttcgtttatatcatgaaaccttcggtctcttctgtccagcggtaggggcggcacccctcgatccggtgcaggagggcagatggccctcttccatgaaaattcggtgaagattttgaggcatagttcagtggttttccccgggagacacgagtttgttgggtatcggttcttaggttttttctttgttgtggttcggtcactcgtgtgcttctcttcgatgacaagtgtgtggggggtccaacagtgcactcccggtgctttgttggttgtgttgtttgtgtagtttttttagccgacctgtatgacggttttctctacaccttatgttgttcggccgtgtggggagaaagtctgatcatgaaaaagcgtagcgagttaccgccatgaatttggtgagggttggttggcctcaaatgtctttgagtgcctggtatagggg

SEQ ID NO: 441 - DNA, 635 bp, Secale cereale
gcaagcaagcagcatattcttgaggggttctgatcagtctcggcctctcaggggaacaagagaagagactgcttggtgaattcgctggtgccgtgtgatcaagagctcggcgggttaattcagttagttggaatggagttggagatggtgagccagcacggggcgctgctcaaggtggggctgttcgtgctggtgcaggcgctggtgtacctcatcctcgcccagtcctcctccgtcttctccagcaccaagaccctcggcctccccccggcgcgctccctcagcgcccgccgcatggtcgcgctgctctccgacctgccgctcggcggcgagccctcgccccgcgccctctccctgctggagccgtcgtcgcccgtgcccctcgcctaccagaagaaggattagttattaaccaagcgcgcgcgattggcggcagggacacggaccgggataagcaaacgatcgtttcccgagctagtagtactcggtgcgtgctgtgggagctattcacgccattctttgattgatttattaattggcttgttccttgggtttgtgcaattaagtgaccatgtgagattatgtattggctaccgtgcaatcatacgtgcttctgtttttgaggagaaacttct

SEQ ID NO: 442 - DNA, 655 bp, Triticum aestivum
cacagcaagcaagcaacatatcctggttagaaccgagtctcagggaagaaacttggtgaattttcgcgggtgtcgtgtgatcaaagctcgggagtcggaatggagttcgagatggcgagccagcacggggcgctgctgaaggtggggctgttcgtgctggtgcaggcgctggtgtatctcatcctcgcccagtcctcctccgtcttctccaccaccaagaccctcggcctcccgccggcgcgccccctcagcgcccgccgcatggtcgcactgctctccgacctgccgctcggcggcgaaccctcgccccgcgccgtctccgtggagccgtcgtcgcccgtgcccgtgcacgcccaccagaagaaggattagttgacagagctgggaggtggctactgtctagcgagcgagcgtatgcacgttgttggttccgtgccaatggttggtgcctgccgtgggagtttgctagctattcacgccattctttggtggttcattgattggtcggtttgttctttgagattgcatatatgtaaactgcacgccgttttggattgtacaaatgaccgtctaagattgtgcttcggttacagtgcagtcgtgcttctgttttgagtggagacttgtgatgaacagagttcgtttatatcatgaa

SEQ ID NO: 443 - DNA, 883 bp, Triticum aestivum
ccggttaaccgttaaccggtacggcctcccacgcagccgtcagtgagacgaccaaccgagacaatattatatgtccgcacacgtgagcggtgagcggagcacggagcaggtcgagcagccagcgtccatccaattccaaccccgtgggattggcgtcgcctttcgccgaaccaccccaaacgactggccggcgaagcatctttgcgttgcacgctgcccaaccccggcagcggtcaaatcggcgtctcgtctcgccgttatataagtgcgcgccccgcgccttcagaactcacaaacacatcaatcaagcaagcagcgtattcttgagggattctgatcagtctcggcctctcagggaaagaagagactgcctactgaactcgctggtttcgtgtgatctagagctcgggggttactctagttagttggcatggagttggagatggtgagccagcacggtgccttgctcaaggtggggctgttcgtgctggtgcaagcgctggtgtacctcatcctcgcccagtcctcctccgtcttctccaccaccaaaaccctcggcctccccccggcgcgctccctcagcacccgccgcatggtcgcgctgctctccgacctgccgctcggcggcgagccctcgccccgcgccggcatcgtggagccgtcgtcgcccgtggccctggccgcgcacgcccaccagaagaaggattagttcgtgttagctatccacaccattctttgattgattgattgtttggttcgttctttgggactgtatatatatgtaaactgaactacacgccgatgtggtttgtgcagaagaccacagtgcggtcgtgcttgtgttggctttgacgagagacttgcataagttttctctaaataa

SEQ ID NO: 444 - DNA, 626 bp, Secale cereale
gcaagcagcatattcttgagggattctgatcagtctcggcctctctgggaagcaagagactgcttggtgaattcgctggtgccgtgtgatcaagagcccggcgggttaattcagttagttggaatggagttcgagatggtgagccagcacggggcgctgctcaaggtggggctgttcgtgctggtgcaggcgctggtgtacctcatcctcgctcagtcctcctccgtcttctccaccaccaagaccctcggcctccccccgacgcgctccctcagcgcccgccgcatggtcgcgctgctctccgacctgccgctcgccggcgagccctcgccccgcgccgccttcacggagacgtcgtcgcccgtgcccctcgcccaccagaagaaggaatagttcgtgttagctattcacatcattctttgattgattgattggttcgttctttgggactggatatatatgtaaactgaactacacgcccgttgtggtttgtgcaaacggaactactcggcgccttgtgcaaaagaccatctaggattgtgtttcagtcacagtgcggtcgtgcttgtgttggctttgagaagagacttgcattagttatctctaaataaaagctttcatcagtc

SEQ ID NO: 445 - DNA, 626 bp, Secale cereale
catcaatcaagcaagcaagcagcatattcttgagggattctgatcagtctcggcctctcagcgaagcaagagaagagactgcttggtgaattcgctggtgccgtgtaatcaacagctcggcgggttaattcagttagtaggaatggagttggagatggtgagccagcacggcgcgctgctcaaggtggggctgttcgtgctggtgcaggcgctggtgtacctcatcctcgcccagtcctcctccgtcttctcaagcaccaagaccctctgcctcccgccggcgcgctcgctcagcgcccgccgcatggtcgcgctgctctccgacctgccgctcgccggcgagccctcgccccgcggagcattcgcggagccgtcgtcgcccgcggccctggccgcgcacgcccaccagaagaaggattagttcgtgttagctatccacgccattctttgattgattaattgattggttcgttctttgggactggatatatatgtaaactgaactacacgcccgttgtggtttgagcaaaagaccatctaagattgtgtttcagtcacagtgcggtcgtgcctgtgttggctttgaggagagacttgcattagttttctctaaataaaagctttca

SEQ ID NO: 446 - DNA, 345 bp, Avena sativa
gtgaccaaagctagggaggtcgtggcaatggagttcgagatggtggcgagccagcacggggcgctgctcaaggtcgggctgttcgtgctggtgcaggcgctggtgtacctcatcctcgcccagtcctcctccgtcttctccagcaccaagaccctcggcaagttccgcccgtcgaggtccctcagcgcccgccgcatggtcgcgctgctctccgacctgccgctcgccggggagccctcgccccgcgccgtctccggggagccgtcgtcgcccgtccccatgctcgcccaccagaagaaggattaagtaaaccaagcgcgacttgcgacgcgcgcgggcacggac

SEQ ID NO: 447 - DNA, 632 bp, Secale cereale
aagcaccatattctcgagagattctcagtctccgccaactgcttggtggtgtcgcgtgatcaaagctcgggagtcggaatggagttcgagatggcgagcctgagccagcacggggcgctgctcaaggtggggctgttcgtgctggtgcaagcgctggtgtacctcatactcgcccagtcctcctccgtcttctccaccaccaagagcctccgcccggcggactccctcggcgcccgccgcatggtcgcgctgctctccgacctgccgctcggcggcgagccctcgccccgcgccgtctccgtcgagccgtcgtcgcccgtgcccgtgcacgcccaccagaagaaggattagttggccgagctgggaggtggctactctctagcgagcgagcatatgcacgtcgctggttccgtgccaatggttgtggttggtgcctgccgtgggagttcgttacctactcacaccaatgacaccattctttggtggtttctttgattggtcttggtcggtttgttctttgagattgcatatgtaaactacgcgccgttttggattgtacaaatgaccatctaagattgtgtttacggttaaaaaaaccaaaacgcgacaccacgagcacaggaggtagagcc

SEQ ID NO: 448 - DNA, 762 bp, Hordeum vulgare
aagccggcgtctcgccgttatataagaccgcagcccacacctccagacctcacaaacacatcaagcattctcgacagattctcagtctcggcgtctcaggggagaattcggtgaactcgctggtgccgtgtgatcaagagctcgatcgggggttaattagtcagctggaatggagttggagatgatggcgagccagcacggggcgctgctgaaggtggggctgttcgtgctggtgcaggcgctggtgtacctcatcctcgcccagtcctcctccgtcttctccaccaccaagaacctcggcctccccacggcgcactccctcggcgcccgccgcatggtcgcgctgctcgccgacctgccgctcgacggcgagccctcggcccgcgccggcttcgtggagccgtcgtcgcccgtggccctggcagcgcacgcccaccagaagaaggattagtgaaccgaaccacgatgattcgcagcgtgggcatggatcgagctggaggaggcagctatcgagcgagcatatgtctgccgaggtagcagttggtgcccgccgtaggagttcgttagctattcgcgccattgtttggtggtcctttgattggttggtttcttctttgagatttcatatgtaaactgcacgccgtcttgggttgtaaaaaccaccatctaagattgtgtttcggttaacagtgcaacgttttgataagagcttgtgacgaacataacactcacacatgaagatcacataacacgaagaattca

SEQ ID NO: 449 - DNA, 629 bp, Avena sativa
caagcaacttactctcgatcaatctcacggaagtcttagctcaatcgatcgtgtgaccaaatctagggaggtcgtggcaatggagttcgagatggtggcgagccagcacggggcgctgctcaaggtcgggctgttcgtgctggtgcaggcgctggtgtacctcatcctcgcccagtcctcctccgtcttctccagcaccaagaccctcggcaagctccgcccgtcgaggtccctcagcgcccgccgcatggtcgcgctgctctccgacatgccgctcgccggggagccctcgccccgcgccgtctctggggaactatcgtcgcccgtgcccatgcccgtggcctcccaccagaagaaggattaagtaaaccaagcgcgatgtgcgacgagggcacgaaccgagtagggagatagaagccgcggcgagcaagcatatgaacgttgctggtttcgagctagataatggttggtgcctgctgtacttagcagtttgttatatagctacgacgtactcaccatttctttgtttgattgatttgttcttttggggttgcatgtgcaaattacatgcctttccgacttgtacatgaccatatgaaattttgctttggttacagtcccctcataag

SEQ ID NO: 450 - DNA, 774 bp, Secale cereale
accagagctccacaggaagagctaagcaatagcatcgcatcagatcaccaacatccattcctagctcgctatctgatcctaatggcgagcagcaccgctctctcctgcctggccgcgctcctgctcctcgctgccgcagcggcgccggcatcggcggccgagaaggagacccggctgcgggtgtactggcacgacgtggtgagcggggggccgaacgcgagggtggtgcaggtggcgcaggcgccgtcctccaacgcctccgccacgggcttcggcaccgtgctcgtcatcgacgacccgctaaccgaggggcccaacctgacgtcgaggctcctcggccgcgcgcagggcatgtacatcagcgccggcaaggacagcctgtcgctgctcatggccatgaacttcgtcttcgtcgacggcgcctacaacgggagcagtatcgccatcatcgggcccaaccaggcggacagggctgtcagggagatgcccgtcgtcggcggcaccggtgtcttccgcttcgcgcgtggctactgccagttgcggacccactggttcgacgctaagaccggcgacgccaccgtcgagtacaagatccatctccgccacgactgatgcattctcagctggactaataataagcttgttgttcctacacatatggtttcctgatttttacccctagcttttttaaaatttcgaggttatgtgcatgtgttgtacggatatgattattcggaataataccggaagttaataaacatttcagttgtggaa

SEQ ID NO: 451 - DNA, 1190 bp, Hordeum vulgare
gttaaatacacccatctctgcaccattggagagcaagctgcacaaaccagagctcctcacaggaagagctaagcactcgcatcgcatcagatcaccattcaccaacatccattcctagctacctagctgatcccaatggcgagcagcaccgctctctcctgcctggccacgctactgctcctcgcggccgccgcggcgccggcgtcggcggcggagaaggagacccggctgcgggtgtactggcacgacgtggtgagcggcgggccgaacgcgagggtggtgcaggtggcgcaggcgccgtcctccaacgcctccgccactggctttggcaccgtgctcgtcatcgacgacccgctcaccgaggggcccaacctgacgtcgaggctcctcggtcgcgcgcagggcatctacgtcagcgccggcaaggacagcctgtcgctgctcatggccatgaacttcgtcttcgtcgacggcgcctacaacgggagcagcatcgccatcatcgggcccaatcaggcggatcgggccgtgagggagatgcccgtcgttggcggcaccggcatctttcggtttgcgcgtggctattgccagttgcggacgcactggttcgacgccaagaccggcgacgccaccgtcgagtacaagatccatctccgccacgattgatgcgttgttcctatatatgatttcctcgtttcaccgctagtttatttttaattccgagggtatttatgtgtgttttacggagatgatttattccgaataatacgaggtgttaataaacatttcagttttggaatgagatataattggttcaatatcttttttgtgtccacggtcccacacgcccgcgtgacagtcagcacgcgccctcacctttgaatctgtctggcccctcttccatgtttgtttaactgtagttgccatgattgctgaactgcgcccgcatgtccagcctcctatcccacggtcccacacgcccgcgtgacagtcagcacgcgtcctcaccttcgaacctgtccggcacctctttcatgtttgtttaactgcagttgtcatgattgctgaactgcaattgtcatgtgtggacaactatagttgtcatggttgttcaactgcagtcgtcatgtttgaacaaactacagttgccatctcaggtcaagtgcagttgtcatttatggacaactgca

SEQ ID NO: 452 - DNA, 713 bp, Secale cereale
atcgcatcagaccaccaacacccattcctagcttgctagctgaatcccaatggcgagcagtaccgctctctctgttttggccgccctcctgctcctcgcggctgccggggcgccggcgtccgcggcggagaaggaaacccggctgcgggtgtactggcacgatgtcgtgagcggcgggcccaacgcaagggtggtgcaggtggcggaggcgccgtcctccaacgcctccgccacgggcttcggcaccgtgctcgtcatcgatgacccggtcaccgagggccccaacctgacgtcgaggctcctcgcccgcgcgcagggcatgtacatcagcgccggcaaggacagcgtgtcgctgttcgtggccatgaacttcgtcttcgtcgacggcgcctacaacgggagcagcatcgccatcttcggggccaatcaggcggaccgggccgtcagggagatgcccgtcgttggcggcaccggcgtcttccgcttcgcgcgcggctactgccagttgcggacctaccggttcgacgccaagaccggcgacgccaccgtcgagtacatgatccatctccgccacgactgatgcgttgtcagctggactaataataagcttgctgttcctacacatatggtttcctgatttttacccctagcttattttaaatttcgagggtatgtgtgcatgtgttgtacggatatgattattcggaataatg

SEQ ID NO: 453 - DNA, 938 bp, Triticum aestivum
accacgactcgccgttaaatagatccacctctgcgccattggacatacaagctgcacaaacctccagctcctaggaagaagaattcggcactcgcatcaaaccaccaacatccattccgagcttagctagctagctgatcccaatggcgagcagcaccgccatctcttgcctggctgcgctcctgctcctcgcagccgccgcggccccggcgtccgcggcggagaaggagacccggctgcgggtgtactggcacgacgtggtcagcggcgggccgaacgcgacggtggcgcaggtggcgcaggcgccgtcctccaacgcctccgccacgggcttcggcggcgtctccgtcatcgacgacccgctcaccgaggggcccagcctgacgggctccaggctactcggccgcgcgcagggcctctacgtcagcaccggcaaggacagcctgtcgctgctcatggccatgaacttcgtcttcgtcgacggcgcctacaacgggagcagcatcgccatcgtcggccccaacccggtgaaccgggccgtcagggagatggccgtggtcggcggcaccggcgtcttccggttcgcgcgcggctactgccagttgcggacccactggtttgacgccaataccggcgacgccaccgtcgagtacagggtccatcttcgccacgactgatgcatgcatccttgtttcgtgcccggtcggtactatgattgttaattcgttgttatgatccaatatatgatttcctgatttccaatatatgatttcctgattttaccgatagcttattttcatttcgagagtatgtgtatatgctttctgagatgatttatttggaaataaataacggaattaccactaactagcgacggtcgtttatttttgtttaggtaaaacctaaaaaccgaaacgttacttttcccgttaacccgt

SEQ ID NO: 454 - DNA, 683 bp, Hordeum vulgare
aagctgagcaatccagaccaccaatatctattcctagcttgctagctgatcccaatggtgagcagcaccgctctctctgtcttggccgcgctcctgctcctcgcggccgctggggcgccggcgtccgcagctgagaaggaaacccggctgcgggtgtactggcacgacgtcgtgagcggcgggccgaacgcaacggcggtgcaggtggcggaggcgccgtcctccaacgcctctgccacgggcttcggcagcgtggtcgtcatcgacaactcgcttaccgacgggcccaacctgacgtcgaggctccttggccgcgcgcagggcgtctacgtcagcgccggtaaggacagcctgtcgctgttcgtggccatgaacttcgtcttcatcgacggcgaatacaacgggagcagcatcgccatcatcgggcccaatcgggcggacccggccgtcagggagatgcccgtcgtcggcggcaccggcgtcttccggttcgcgcgcggctactgccagttgcggacccactggttcgatgccaagaccggcgacgccaccgtcgagtataagatccatctccgccacgactgatgcgtccttcctagagtatatatgatttcctgattttaccgttagcataatgcgggttgtaaacaaacatttcagttttggaataaagcataatctgg

SEQ ID NO: 455 - DNA, 447 bp, Aegilops tauschii
ccggcctggccgcgctcctgctcctcgcggctgccggggcgccggtgtccgcggcggagaaggagacccggctgcgggtgtactggcacgacgtcgtgagcggcgggccgaacgcgagggtggtgcaggtggcgcaggcgccgtcctccaacgcctccgccacgggcttcggcaccgtgctcgtcatcgacgacccgctcaccgaggggcccaacctgacgtccaggctcctcggccgcgcgcagggcatgtacatcagcgccggcaaggacagcctgtcgctgctcatggccatgaacttcgtcttcgtcgacggcgcctacaacgggagcagcatcgccatcatcgggcccaaccaggcggaccgcgccgtcagggagatgcccgtcgtcggcggcaacggcgtcttccgcttcgcgcgcggctactgccagttgcggacccact

SEQ ID NO: 456 - DNA, 1378 bp, Aegilops tauschii
catgacaataccccatctgcacacttttcctcaagaaggtgcccgcatgcataaataaagccagacgaggcgtaccatcaagcagccaagaaacgaagctgctaggtgctcggcgcacacatgtcgtcatcctcctctgccccagcggccgccgtgccgacgtcgacccgcctcatcctggtgcacggcacgggccacggcgggtggtgctggtacaaggtggccaccctcctccgcgccgcggggcaccgcgtcgacgcgccggacctcgcggcatgcggctccgacgcgcgccggctgagcgacgcgcccaccttcgaggactacacgcgccccctgctcgacgcgctccgggacctcccggacggcgagcgggcggtgctcgtgggccacagcttcggcggcatgagcatcgcgctcgccgccgaggagttccccgacaaggtcgcggccgccgtgttcctcaccgccttcatgcccgactgcgacggcccgcgcacccgcgtcatcgaggaggttcccgtgtccgactggatggacagcgtggtcgacgaggagcacgccccgccgtcggtgttcctcggccccgagttcgtgcgccggaagctctaccagctgacttccgaggaggactacacgctgtgccagagcctggcgcgggtgagctcctactacgtggccgaccagcagcaacggccgccgttcagcgccgcccggtatggcgcggtgaccaaggtctacgtgatcgccaagcaggacctggccatggtcgaggagtaccagaggcagatgatcgcaggcatccccgtggctgaggtgagggagatggctgatgccgaccacatggccatgctctccgcgccggaggaactggcgggccacctcgccgacatcgccaacaactacacttaatcgagttgcggagcctacttatactgttcctaatataaaacgcatgtcttccctagttggattgtacttacaattacaagaaatctactgaaatgtgagtccagatgtaccgcagacgagggctctttctttcaaatgaattttatataaattacatgtggtatgcaaatctgtagatattttccaatagaatctagtatttgattcaaaggaacaaatgtttcaaactctgtattgatcgtcatcctacacttttttttatcaattttgaattttacttcgtgcctatgatacccatgatatgaatttgatctctttacaaaattccttatttttcttatggggcaaacaaacaacttgttgatatttgtgtactttattcctgtaggattccgacttctgtatgttttttaaatcttgctaaccaaagctaaccaaacaactgctgcagcgtatttagagttgg

SEQ ID NO: 457 - DNA, 1048 bp, Secale cereale
catgtcgtcctcctcctctgcgcccgcgctcgccgtggcgacgtcgacccggctcatcctggtgcacggcacgggccacggcgggtggtgctggtacaaggtggtcaccctgctccgcgccgcggggcaccgcgtcgacgcgccggacctcgcggcctgcggcgccgacgcgcgccggctgcgcgacgcgcccaccttcgaggactacacgcgccccctgctcgacgcgctccgggccctcccggacggccagcgggcggtgctcgtgggccacagcttcggcggcatgagcgtcgcgctcgccgccgaggagctccccgacaaggtcgccgccgccgtcttcctcaccgccttcatgccggactgcgacggcccgcgcacccgcgtcgtcgaggaggtccccgtgtccgactggatggacagcgtggtcgacgacgagcacgccccgccgtcggtcttcctcgggcccgacttcgtgcgccggaagctctaccagctgagccccgaggaggactacacgctgtgccagagcctcgcacgggtcagctcctactacgtcgccgaccagcagcagcggccgccgttcaccgctgcccggtacggcgccgtgaccaaggtctacgtggtcgccaagcaggacctcgccatggtcgaggagtaccagaggcggatgatcgcaggcatccccgtggctgaggtcagggagatggctggcgccgaccacatggccatgctctccgcgccggaggaactggcgggccacctcgccgacatcgccaacacctacacttaatcgagttgcggagcctacgtataataaaacgtctattttcccaagttggattgtactaccaacctaaaatgtcttgtaaatatttacagagggagtactttatatacaagtataaactcagaaatttactaaaaatatgtactagaaactttgtattgactgtttttcctaacgactaaaaaaaaaaaaaaaaaaaataaactagaagtactacgaacgaagacaacaggaagggtagtaggggggggggggggg

SEQ ID NO: 458 - DNA, 1295 bp, Hordeum vulgare
agtcgtccttctttagcgagctgtaaaccgtcgcattcatggcgatgatggaaacgggcacgaacacgtctactgaacgccaatgcagaaaggaagcggcgtgttgacccgcggtagcgtacgttgcatcagccatgacaatatacttctctcgaagatgcccgaatggccgcatatacgtaaataaattgagaggcgaaacatcaaggaggcaagaaaagaagcagctagctaggtggctactccagtgctcggcgtcggcgcacagatgtcttcttcctctgtgccagcggccgccatggcgacgtcgacccggctcatcctggtgcacggcacgggccacggcgggtggtgctggtacaaggtggccaccctgctccgcgccgcggggcaccgcgtggacgcgccggacctcgcggcctgcggcgccgacgcgcgccggctgagcgacgcgcccaccttcgaggactacacgcgccccctgctcgacgcgctccgcggcctcccggacggcgagcgggcggtgctggtgggccacagcttcggcgggatgagcatcgcgctcgcggccgaggagttcccggacaaggtcgcggccgccgtgttcctcaccgccttcatgccggactgcgccagcccgcgcacccgcgtcatcgagacggtccccgtgtccgactggatggacaccgtggtcgacggggggcacgccccgccgtcggtgttcctcgggcccgagttcgtgcgccggaagctctaccagctgagcccggaggaggactacacgctgtgccagagcctggcccgggtgagctcctactacgtggccgaccagcagcaacggccgcgttcagcgctgcccggtacggcgcggtgagcaaggtctacgtgatcgccaagcaggatctggccatggtcgaggagtaccagaggcagatgatcgcaggcatccctgtggccgaggtgagggagatggcggacgccgaccacatggccatgctctccgcgccggaggaactggcggggcacctcgccgacatcgccaacacctacacttaatcgattgcggggcctatttacgaatctgtatattgaatgtctattttccgtagttggattgtgtacttatacaagaacaaacgaaataatctactgaaatgtgagttgacatgtaccgcacacgagggctctttccttcaaatgaattttatataaattatttagtatgcaaatctgtagaaaattcgcaaaataatctatttgattcaaagggataaacgtttcaaactttgtattca

SEQ ID NO: 459 - DNA, 1199 bp, Brachypodium distachyon
gtaccaccaacaccaaaggagagttccaccagaacgaagccgcttaagcaggcaggcaggcagcccataccagagtaccagactagctaccagagcagaggagcgcccggcggcccggccatgtcgtcctcgtccatgctgccggcagccgcgaccgcggcctcgaagcggctgatcctggtgcacggcacgggccacggcggctggtgctggtacaaggtggccacgctgctccgcgccgcgggccaccgcgtggacgcgccggacatggccgcctccggggccgacgcgcgcccgctccgggacgcgcccaccttcgaggactactcgcgcccgctcctcgacgccctccgagcccttcccccgggcgaaaaggcggtgctcgtcggccacagcttcggcgggatgagcgtggcgctggccgccgaggagtttcccgacaaggtggccgcggccgtgttcctcacggccttcatgccggactgcgcacacccgcgcacgcacaccatcgaggcgctccccgcggggctggactggatggacagcgtgacggacgaagggcacgccccgccgtccgtgttcctcgggccgcagttcctgcggaggatgctgtaccagctctgcccggaggaggattatactctgtcgcagagcctggccagggtgagctcctactacgtggccgaccagcggcgccggccgccgttcagcgcggaccggtacggcgccgtgagcaaggtgtacgtggtcgccaagcaggacctggccatggtggagcagtaccagaggcagatgatcgctagcgtccccgtggcggaggtcagggagatggctggagctgaccacatggccatgctctcggcgcccgaggtgctggcgggacacctcgccgacatcgccaacacctacgcttgattctattgctgagcctatgtccccccgagacgactctgtttttacactgctgctgcatcatcgtccaatgtcatattatccttgttttgatcttaataaaaaataatcaatcatgcatttctgtatcagaaaagacttgtgactagttagtcatgtaagcgtgcacggggtgcaatgtacgattcactgtcttctccaactcggtgaatcaagcagcccatgtactcaaccattccaacactgtagaaagaaatataaagaacaagcagcgttcgcaattgcaa

SEQ ID NO: 460 - DNA, 930 bp, Hordeum vulgare
atcaagtcccaacgaaccccaaaaaatattctcagcacttgcacccaggcaaagattccatgggagcgaagctttcctgcttttccaaccaccgaggcggcctctcgcagcagccacgccaaccggcgcctgtcagggtcattgccgcggacggttcgctgaaggaactcccggccagcccaggcgtcaccgtctccgacgtcctcggcggcagcgccgcgtccttcttcgtgtgcaactccgacgcgctctacttcgaccagagccctccggcgctggcatccggcgaggtactccggccgggacagatatacttcgtgctcccggcggcgttgcaacggcggccgctgtcgagcgccgagatggtctcgcttgcggtgcgcgcgagctcggcgatcgcggacaagaagccgcagcagaggcgggggcgcttcagcggcgggaagaagaaggtgcgcgtcatgccggtgcacgaggagttggaggacggcgaggacgttctgctgaacgagaagcttaacgagcggacgctcggggagttcgctgtgtcgccgaagagcgaagaaaagatcgccgtcgtgggagcgcggtcgcggctgaagatgaagctgaagcgcgctctgagtatcattcaagaggttgctgaatgaagcgtacctcaaaaagttgtaaatactactactactagtgtttttttattttagtttttggttttgtttgaagcccaaatatttaattggtttagtagatttaggataacaagaacatgaattctgcgaaacagtatgtgaatacgtgtcgttcctaaatactttctccgtccgaaattatttgtcgcaaaaatttataaagtaggatgtatcttaaaataaaatacatctagatgcattcattcttgtgacaagtattttcggacggagcgagtatagt

SEQ ID NO: 461 - DNA, 1894 bp, Secale cereale
ccgacctcttctcttcttcctcctgcctgtatatctccggatttccaatccccagtgagagattgcttccgtctacctcccgagccccagcttccctctccaatcccccttctccgtgtgatttttgagccaccgcagaaacaacaatggagatgggtagcttccctttcttctacgtcgccgccatcacctttctcaccgtctttttgctccactccttcctcaccaagaagcggcgacggctgccacccggcccggcgctggcagtcccgttccttggccacctccccttcctcaagaagcctctgcacgccacgctcgcgcgcctcgccgcgcgccacggtccggtcttctccctcgcctcggctcgcgccccgccgtcgtcgtcacctcggcggagctcgcaagggactgcttctcctccgacctcgacgccacgctcgccaaccgcccgcacttcccgtccgtgcgggaggtctccttcgactacaccgtgctcaccctcgccagctacggcgctcactggcgcgccgcgcgccgcgtcgccgtcgtgcacctcctctccgcgcgccgcgtagacctcatgtccgacgccgtcgtcgcccgcgagctgcgcgccctggtgcgccgcctcgcgcgccttaccgtcggcggtgccgcggcgagggtggagttgaagcggcggctgttcgacctctcccactgcgtcctcatggaggccatcgcgcggagcaggaacacctactccgacgacggagcggacatgtcccaggaggcgcgggagatgaaggacatcgtggacgccatcgtgccgctcgtcggtgtcgccaacctgtgggactatcttccggtgctgcgctggctcgactggcgaggtgtcaggcggcggctggcggacgcaacgagccggaggaacgccttcatctacaagctcatcgacagggagaggcagaagcagcaggccgccgccgacgagccggaggaggagcagggcatgatcggcgtcatgctctcgctgcagaagtcagagcccgacctctacacggacactttcatctccgccctcatcgccaatcttcttggcgtcggcacagagacgacgtcgacgacgacggaatgggcgatggcgctcctgctgaaccacccggcggtgctaaagaaggcacaggaggagatcgacgcgcaactcagcggcgagccgagccgcctcctcgacaagaaagacctgccccaccttccttacctccactgcatcatcagcgagacgctgcggctgtgccccgccgcgccgctgctgctgccacacgaggccgccgccgactgcaagctccacgggtacgacgtcgccgctggcacgatcgtgctcgtcaacgcttacgccatccaccgcgacccggcggcgtggggaccggcgccggaggagttcaggccggagaggttcgagcacggcagcgccgaggggaagctcatgatgccgttcgggatgggaaggcgcaagtgccccggggagagcctcgccatgaggaccatgggcttggttcttggcacgctcatccagtgcttcgattggacaagggtcggggatgaagaggtcgacatggccgcgagttccgggaccgtcatgttcaaggccgtccctctggaagctctctgcacaccgcgagccggcatggatactcttcttcagaagctctaaactgaaaatgataaaaggaagcagaaaataattggcacaaaagagcgcacactagaaatataagtgtagtggtactactatagtgcaagtaaaataaaaaataaaaaaactacagtgtaagcaagtacacattgcatattttgtacctttcgctttcaacaatgttcctgtgaatacatcttcgctgatgcaaaagtc

SEQ ID NO: 462 - DNA, 1875 bp, Hordeum vulgare
gctcttcttcctcctctatatcttgggatttccaaccaatcaatccctagtgagagattgcttccgtctacctcctgaaccccagcttccctctccaaccctccttctctgtgtgatttatgaggtactccgttctaggttcgtgacacttcaccgcagaaacaagaacaacaatggagatgtgtagcgtccccttcttctacgtcgccgccatcacctttctgaccgtccttttgctccactccttcctcaccaagaagcgacggctgccacccggcccggcgctggctctcccgttccttggccaccttcccttcctcaagaagccgctgcacgccacgctcgcgcgcctcgccgcgcgccacggcccggtcttctccctccgcctcggctcgcgccccgccgtcgtcgtcacctcgtgggaggtcgccaaggagtgcttctcctcggacctcgacgccacgctcgccaaccgcccgcacttcccgtccgtgcgggaggtctccttcgactacagcgtgctcaccctcgccaactacggcgcccactggcgcgccgcgcgccgcgtcgccgtcgtgcacctcctctccgcgcgccgcgtagacctcatgtccgacgccgtcgtcgcccgcgagctgcgcgccctggtgcgccgcctcgcgcgccttaccgccggtggtggtggtagtgcggcgagggtggagctgaagcggcggctgttcgacctctcccacagcgtcctcatggaggccctcgcgcggagcaggaacacctactccgacgacgaagcggacatgtcccaggaggcgcgggagatgaaggacgtcgtggacgccatcgtgcccctcgtcggtgtcgccaacctgtgggactaccttccggtgctgcgctggttcgactggcgaggcgtcaggcggcagctggaagacgtaacgagccggaggaacgccttcatctacaagctcatcgacagggagagacagaagcagcagaagcaggaggaggagcagggcatgatcggcgtcatgctctcgctgcagaagtcagagcccgacctgtacacggacactttcatcgccgccctcgtcgccaaccttcttggcgtcgggacagagacgacgtcgacgacgacggaatgggcgatggcgctcctgctgaaccacccggcggtgctaaagaaggcacaggaggagatcgacgcgcacctcagcggcgagccgagccgcctcctcgacaagacggacctgccccaccttccttacctccactgcatcatcagcgagacgatgcggctgtgcccggcggcgccgctgctgctaccgcacgaggccgccgccgactgccagctccacgggtacgacgtcgccgcgggcacgatcgtgctcgtcaacgcttacgccatacaccgcgacccggctgcgtggggaccggcgcccgaggagttcaggccggagaggttcgaggatggcgtcgccgaggggaagctcatgatgccgttcgggatgggaaggcgcaagtgccctggggagagcctcgccatgaggaccatgggtctggttcttggcacgctgatccagtgcttcgattgggcaaggatcggggatgaagacgtcgacatggcctcgagttccgggaccgtcatgctcaaggctgttgctctggaagctctctgcacaccgcgagccggcatggatgctcttcttcacaagctctaaactgaaaattattgtaaaaggaagcaggaaataattggcacaaaagagcacacactagaaatataaatgtagtgctactactatagtgtaactaataaccccacagtacatacacattgcatggtttgttcaacaatgttcttgtgaatacatcttcgcg

SEQ ID NO: 463 - DNA, 580 bp, Secale cereale
tcagcgagaagcaagagtttgtccctatcctacgtacacaaagcgtccatccgtccctcggttcctaagctaggcagcagggtttgtccgtgtcgatcgatcgatcgacgctcgtcctcttcgtcgccggcatgcagcgcagcaactcgttcgggacgtcgtgggcggaccagtgggacaccggcgccgacccgagcccgcgggcgcgcggcaacggcaacggcggcaacggcgacggcaagaagggcggtgtggagaagaccaaggcggccgcggccaccgggctgaagaaggtcaaggccggcaccgcgcaggggttccagtggatcaaggacaagtaccagaagaaaagcgccggcaagaacggcaagcagggcgccggctccgaggtggcggccgggtactgaccgctgctccttcatgcgtgtggatatatgtggagtcggtcatggaccgatgatgttcttgttctagcgttgtgtctgcggactggttagcttgctctgttttcatatacagtacgtataatatagcccttctcatgtacataaatgaaggatttgatttttgttctggttct

SEQ ID NO: 464 - DNA, 665 bp, Secale cereale
ccgtccctcctctccggcgacctacgacgtaagcagagttgtcctacgtacgcacacaaagcatccatccgtccctcggttcctaagctaggcagcagggtttgtccgtgtcgatcgatcgatcgacgctcgtcctcttcgtcgccggcatgcagcgcagcaactcgttcgggacgtcgtgggcggaccagtgggacaccggcgccgacccgagccctcgggcgcgcggcaacggcggcggcggcgacggcaagaagggcggcgtggagaagaccaaagcggccgcggccaccgggctgaagaaggtcaaggcgggcaccgcgcaggggttccagtggatcaaggacaagtaccagaagaagagcgccggcaagaacggcaagcagggcggcagctccgaggtggcggccgggtactgaccgctgctccttcatgcgcgtggatatatgtggagtcggtcatggaccgatgatgttcttgttctagctttgtgtctgcggactggttagcttgctctgtttttatatacagtataatatagcccttctcatgtacataaatgaaggatttgatttttgttctggttcttcatactttgatcatcgtttccgacttacatctgattggtgactgtcgactaaaaattgttccttgactcaaaaaaa

SEQ ID NO: 465 - DNA, 725 bp, Secale cereale
gactgatttccaccccccacccctccagaacgcgtggtcgcgcgtcacggctgagcatctctcgcgccctccgccacaagatttccaccccccacccctccctcctagttgccacgacaggactattcctctctccccgcctccgcctataaagccccggcctcccgtccctcctctccggcgaccacgagaagcaagagtttgtccctatcctacgcacacaaagcatccatccgttcctcggttcctaaggcggcaaggtttgttcgtgttgatcgatcgacggtcgttcctttcgtcgccggcatgcagcggagcaactcgttcgggacgtcgtgggcggaccagtgggacaccggcgccgacccgagcccgcgggcgcgcggcggcaacggcggcggcggcgacggcaagaagggcggcgtggagaagaccaaggcggccgcggccaccgggctgaagaaggtcaaggccggcaccgcgcaggggttccagtggatcaaggataagtaccagaagaagagcgccggcaagaatggcaagcaaggcgccggctccgaggtggcggccgggtactgaccgctgctccttcatgcgtgtggatatatgtggagtcggtcatggaccgatgatgttcttgttctagcgttgtgtctgcggactggttagcttgctctgttttcatatacagtacgtataatatagcccttgtcatgtacataaat

SEQ ID NO: 466 - DNA, 670 bp, Hordeum vulgare
ataaaaccccggcgtcccgttcttcctctccggcgaccacaagaagcaagactttgtccctacctacgcacacaaagcatccatcggttcctcggttcctaagtcagcggagtttgttcgcgttctcttcgtcgccgacatgcagcggagcagctcgttcggcacgtcgtgggcggaccagtgggacaccggcgccgacccgagcccgcgggcgcgcggcggcaacggcaacggcaagaaggtgcagggcggcggcgtggagaagaccaaggcggccgcggccaccgggctgaagaaggtcaaggcgggcaccgcgcaggggttccagtggatcaaggataagtaccagaagaagagcgccgggaagaacggcaagcagggcggcggctccgaggtggcggccgggtactgaccgatgatctgagacgctttccttcgtgcgcgtggatatatatacggagtcagtcatggacggatgatgttcttgttctagcgttgtgttgtctgcggactggctagcttgctctgtttttagcccttctcgtgtacataaatgaagtagtatttggtattgttcttgttcttcatacctgatcaccgtttctgtaagggaatcgtttcccgcccgcgcgccggtcgcccctcgcgcgcgtggacccatgcaacattt

SEQ ID NO: 467 - DNA, 1146 bp, Lolium multiflorum
cccgtagcatttcgtttctttcacaagaccgattcgttccgccgccgtgttttacttctaccaggtggtgttagcaacaaagcaagcaagcaagcaactcgatcgcgctagcaaggcaggtgaagaagacatggcagactaccaccgggtccatccggtgatcgccggctcgccgccggagcaaaccaaggacaagataccacccagcgctacccatggcgagcaagtgcttccaatcacggccccgccaccctacgcgccggcgcccatgcgcgcgccgcggcggaagaggcacagccggtgctgccggtgcgtgtgttggaccctggtggtggccatcgtcctcgtcgtcgcgctcggcgccacggcggggatcctctacgccgtgttcaggcccaagatccccaccttcaacgtggaccgcctgaccgtgacccggttcgacgtgaacaccaccaccgcggtcgtcaccgacgccttcgaggtgcaggtcacggccaacaacccgaaccggcgcatcggggtgtactacgacggtggcgaggtcacggcctccttcaacggcaccgagctctgcagcggcgccttccccgcgctgtaccagggccaccgtaccaccgtgcgcccgctcatcacgctgcagggtgagacgaggctcgacagcgccgtggccgcgcagctcgcgcagcagcagcaggccgggttcatcccgctcacagtgaacgcccgcgtgcccatccggatcaagttcggcgtgatcaagctgtggaagatgaccggaaaggcgcgctgcaacctcgtcgtggatagactccaggcggagacgcggctccgcatccgctccaacagctgcagcttcaagctcaagatctagacaatttttgagtcgttcgtatatggatatctgtctaggattaccgaggtcacgtccccatctctgtcgatctatattccttgagatcgatcgccaggtgtggtatagatgtgtagagctgtgcatttattatttgttttgcccgtacattcgttatttttgtattgcaataagatccgatattccgatatgcatgtattattttaccatgagttcctttggagaataatggaataaaggatatatatgttggttgacacacacataataag

SEQ ID NO: 468 - DNA, 1803 bp, Secale cereale
tcagaagtcctcccagcttgacaaactccactagcacttttgctgccacagccgatcagccatgaccctcgccggcagcggcgatggccagagcggctccgcgagggcgcacttcgtgctggtaccgatgatggctcagggccataccatccccatgaccgacatggcacgcctgctggcagagcacggcgcgcaggtcagcttcatcaccacgcccgtcaacgccgctaggttggagggcttcgccgctgacgtgaaggcggcgggcctggcggttcagctcgtggagctccacttcccggctgcgaagttcggcctaccggacgggtgcgagaacatcgacatgatccaatcaaagaagttcttctcgaacttcatgcaggcctgtggcgcacttcaggagccgctcatggcatacctccgtgagcagcaaagctcgcctcctagctgcatcatatctgacatgatgcactggtggactggtgacatcgcaagggagcttggcatcccgaggctcacctttagtggcttttgtggcttctcgtcccttgtcaggtatatcatttttcacaacagtgtattggagcatgtcacagatgacaatgagctcgtcacgatcccaggatttcctacaccgctagagttgatgaaggctaaattacctggaaccctttctgttccaggtatggagcaaatccgtgaaaagatgtttgaggaggagctgagatgcgatggtgagatcactaatagcttcaaagagctcgagacattgtacattgaatcctttgagcagataacaaggaagaaggtctggacggtcgggccaatgtgcctctgccaccgaaatagcaacacaatggccgctaggggtaacaaggcatcaacggacgaggcacagtgcttgcaatggcttgattcaaggaagacaggctcggtgatctttgtaagctttggcagcctcgcttgcactacacctcaacaacttgttgagctgggactgggactcgaagcctccaagaaaccgtttatttgggtgatcaaagcaggacctaagtttccagaagttgaggaatggctcgcagatgggtttgaggagcgcgtcaaagacagaggcatgatcataaggggttgggcgccacaggtgatgatcctgtggcaccaagccattggaggatttgtgacacactgtgggtggaactcaacaatagagggcatctgtgcaggtgtgcccatgatcacttggccgcactttgccgagcagtttttgaatgagaagctggtggtggatgtgctgaaaatcggggtggaggttggagtgaaaggagttacacagtggggaattgaaaaacaagaggttatggttagaagagatgccgtggagacggcagtgaacaccctgatggatgagggggaggctgcagaggagctgagggtgagagcaaaagactgcgccattaaggcaaggagggcttttgatgaggaaggctcttcttataacaacgtaaggctgttaattcaagaaatgggaaacaagacgaatccatgtgattgatacagatggtaacaagctcaccttttgggtgtaaacatgaagtgaaagatcctagaatacatatatcatcataaagaattttattttacaaataaccagtagcttgtaccaggctcacaggtgggcccctgattatttagagattagagataatctgaatgacagcaacataagttgtcctctctgctatgctctttcatggcaatcaacataattttttattttgaaaatttcaacgggcaggagaggat

SEQ ID NO: 469 - DNA, 2435 bp, Triticum aestivum
cagtgttgaatacgatgcattgcctccattggcgtcactcaaaaaatggactcgtattttccaaatcgatgggggttcttttctctgcagaagcttctcacttacaaaggccttccacagctttgagagttgagcagcaccatgcatatacggcaagtcagcatcagacctgaagaccatccgggcagcaaagtcagtgcattgaatggcgtccaaatcatataaaaatgactcctctttcggcagtagcgggggctaatctgcgccatccgatatctgatcgaaccgcctggatgccccctttctgatggttcagaagtgaagaagattcatccacatggctgactaggagtccatgactgacgtgagagcatgcatcactagtaagaggtgaccaagttgaaacgctgctgctgcgctgcacccattcgattgtcagctcgtcagctcaacttaggaagatatagcaccaggtgctgctgtatatacattacggttgccattgcacggcttccaagtcctcccaacttgacagactccgctcgcacttttgctgccacggccgatcagccatgaccttcgccggcagcggcgatggccagagtggctccgcgagggcgcacttcgtgctggtaccgatgatggctcagggccataccatccccatgaccgacatggcacgcctgctggcagagcatggcatgcaggtcagcttcatcaccacgcccgtcaacgccgctaggttggagggcttcaccgctgacgtgaaggcggcgggcctggcggttcagcttgtggagctccacttcccggcagcggagtttggcctaccggacgggtgtgagaacctcgacatgatccaatcaaagaatttgttcctgaacttcatggagacctgtgccgcgcttcaggagccgctcatggcatacctccgtgagcagcagcgctcgcctcctagctgcatcatatctgacatgatgcactggtggaccggcgacatcgcaagggagctcggcatcccgaggctcaccttcagtggcttttgtggcttctcgtcccttgtcaggtacatcatttttcacaataatttattggagcatgtcacagatgacaatgagctcatcacgatcccggggttccctacactgctagagttgacgaaggctaagttgcctggaaccctttgtgttccgggtatggagcaaatccgtgagaagatgtatgaggaggagctgagatgtgatggtgagatcactaatagcttcaaagagctcgagacattgtacattgaatcttatgagcagatagcaaggaagaaggtctggacgatcgggccaatgtgcctctgccaccgaaacagcaacacaacggccgcaagaggaaacaaggcgccaatggatgaggcacagtgcttgcaatggcttgattcaaggaagccaggctcagtgatctttgtgagttttggaagccttgcttgcactacaccacaacaaattgttgagctgggactgggactcgaagcctccaagaaaccgtttatttgggtgatcaaagcaggacctaagtttccagaagtcgaggaatggctcgcagatgggttcgaggagcgtgtcaaagacagaggcatgatcataaggggctgggcgccacaggtgatgatcctgtggcaccaagccattggaggatttgtgacacactgtgggtggaactcaacaatagagggcatctgtgcaggtgtgcccatgatcacatggccacactttgcagagcagtttctgaatgagaagctggtggtggatgtgctgaaacttggggtagaggttggagtgcaaggagttacacagtggggaagtgaacaacaagaggttatggttaccagagatgctgtggagacagcagtgaacaccctgatgggtgaaggggaggctacagaggagttgagaatgagagcagaagactgcgccattaaggcaaggagggctttcgacgaggaaggttcttcttacaacaacgtaaggctgttaattcaagaaatggaaaacaagacgaatgcatgtggttgatagagattacctaagctcgctttttcggtgtaaacatgaagtgaaacatcctagagtacatatatcatcatatagaattttgtaccaggctcacaggtgattatttagagattatagatgatccaaatgaagggaatatcaattatcctctctattatgtacgctctttcatggcagtccacataacaactacacagtctgctattctagatggttacgctctcccttgcattttgctaccgctgcacgactagccacggttcgtggagacgtaggacaatgactccgagcaactagggaggggcgccgccgtgcaccggacactgcgcttttgcattgcaccaggcactgtacatggcctaataacagacc

SEQ ID NO: 470 - DNA, 1933 bp, Secale cereale
caaactccactagcacttttgctgccacggccgatcagccatgaccctcgccggcagcggtgatggccagagcggctccgcgagggcgcacttcgtgctggtaccgatgatggctcagggccataccatccccatgaccgacatggcacgcctgctggcagagcatggcgcgcaggtcagcttcatcaccacgcccgtcaacgccgctaggttggagggcttcgccgctgacgtgaaggcggcgggcctggcggttcagctcgtggagctccaattcccgagtgtagagttcggcctgccggacgggtgcgagaacctcgacatgatccaatcaaagaatttgttcctgaacttcatggagacctgtgccgcgcttcaggagcccctcatggcatacctccgtgagcagcagcgcttgcctcctagctgcatcatatctgacatgatgcactggtggaccggtgacattgcaagggagcttggcatcccgcggctcacctttagtggcttttgtggcttctcgtcccttgtcaggtacataattattcacaaaaatgtactggagcatgtcacagatgataatgagctcatcacgatcccggggtttcctacaccgctagagttgatgaaggctaagttgcctggaaccctttctgttccgggtatggagcaaatccgtgagaagatgtttgaggaggagctgagatgtgatggtgagatcactaatagcttcaaagagctcgagacattgtacattgaatcctatgagcagataacaaagaagaaggtctggacgatcgggccaatgtgcctctgccaccgaaacagcaacagaacggccgcaagaggaaacaaggcgtcaatggatgaggcacagtgcttgcaatggcttgattcaaggaagccaggctcagtgatttttgtgagttttggaagcctcgcttgcactacacctcaacaacttgttgaactgggactgggacttgaagcctccaagaaaccgtttgtttgggtgattaaagcaggagctaagcttccagaagtcgaggaatggctcgcagatgggttcgaggagcgtgtcaaagacagaggtctgatcataaggggctgggcgccacaagtgatgatcctgtggcaccaagccgttggaggatttgtgacgcactgtgggtggaactcaacaatagagggcatctgtgcaggtgtgcccatgatcacatggccacactttgcagagcagtttttgaatgagaagctggtggtggatgtgctgaaacttggggtagaggttggagtgcaaggagttacacagtggggaagtgaacagcaagaggttatggttaccagagatgctgtggagacagcagtgaacaccctcatgggtgaaggggaggctacagaggagttgagaatgagagcagaagagtgtgccattaaggcaaagagagctttcgacgaggaaggttcttcttacaacaatgtaaggctgttaattcaagaaatgagaaacaagacgaaggcatgtggttgatagagattacctaagctcgctttttcggtgtaaacatgaagtgaaagatcctagaatacatatatcatcatatagaattttgtaccaggctcacaggtgattatttagagattacagatgatccaaatgaaggcaatatcaattatcctctctattatgtacgctctttcatggcagtccacataacaactacacagtctgctcttctagatggttacgctttcccttgcattttgctaccgctgcacgactagccacggttcgtggaggcgtaggacaatgactccgtgggagcaactagggaggggcgccgccgtgcaccggacactgcactgttgcattgcaccaggcactgtacacggcctaataagtaataacagaccttgtttcattgctaaaaaa

SEQ ID NO: 471 - DNA, 2340 bp, Hordeum vulgare
aaacagacaagaaaaatctcatcggaccgcctggacgccgcctttctggaggttcagaactttagaagattcattcatccacgttgccgactccacgagtccatggctgacgttagagcatgcgtcactagcaagaggtgaccaagttgatacgctgcactcgttccaacgtcagctcctcaacttggaacgagtgcaggaagtccataccagtgtagaacaagatgcgctgcactcgttccaacgtcagctcctcaactgaactgcggaagatatatatagcaatagcaccaagtgctatatacacattgcatcgccaccaccaaatccccccagcttcacgtctaagtgccacagccgatcagccatgaacttcgccggcagcggcgatggccggagtggctccgcaagggcacacttcgtgctggtaccgatgatggctcagggccataccatccccatgaccgacatggcacgcctgctggcagagcatggcgcgcaggtcagcttcatcaccacgccggtcaacgccgcaaggttggagggcttcgccgctgacgtgaaggcggccggcctggcggttcagctcgtagagctccatttcccggctgcagagttcggtctaccggacgggtgcgagaacctagacatgatccaatcaaagaacttgttcttgaacttcgtggaggcatgtgccgcgcttcaggagccgctcatggcgtaccttcgtcagcagcagcgctcgcctcctagctgcatcatatctgacgtgatgcactggtggaccggtgacatcgcaagggagctcggcatcccgaggctcaccttcattggcttttgtggcttctcgtcccttgtcaggtacatcatttttcacaacaatgtattggagcatgccacagacgaaaatgagctcatcacgatcccggggtttcctacacctctagagttgatgaaggctaagttacctggaaccctttctgttcccggtatggagaaaatccgtgagaagatgtttgaggaggagctgagatgcgatggtgagatcactaatagcttcagagagctcgaggcattgtatgttgaattctatgagcagataaggaagaagaagatctggacggtcgggccaatgtgcctctgccaccgaaacagcaacacaacggctgcaagaggaaacaaggcgtcaatggatgagacacagtgcttgcaatggcttgattcaaggaagccaggctcagtgatctttgtgagctttggtagcctcgcttgcactacacctcaacagcttgttgagctgggactgggacttgaagcctcgcagaaaccgtttatttgggtgataaaagcaggtcctaagtttccagaagtcgaggaatggctcgcggatgggttcgaggcacgcgtcaaagatagaggcatgatcctaagaggctgggcgccacaagtgatgatcctgtggcaccaagccattggaggatttgttacgcactgtgggtggaactcaacaatagagggcatctgtgcaggtgtgcccatgatcacttggccgcacttttcggagcagtttgtgaatgagaagctggtggtggatgtgctgaaaatcggggtggaggtcggagtgaaaggagttacacagtggggaagtgaaaaacaagaggttatggttacaagagatgccgtggagacggctgtgaacaccctgatgggtgagggggaggctgcagaggagctgaggatgagagcaaaagactgcgccattaaggcaaggagggcttttgatgaggaaggttcttcttataacaacgtaaggctgttaattcaagaaatggaaaacaagacgaatccatgtgattgatacagatggtaataagctcacttttttggtgtaaacattaagtgaaagatcctagaatacatatatatcatcataaagaattttattttacaaataaccactagcttgtaccaggctcacaggtgagccctaattatttagagattatagatgatctggaagacagcaatatcaattgtcctctctggtatgctctttcgtggcaatcaacataattttttaattttgaaaattttcaactggcggcagaggatccccacctaaatatatttcaaaggtcgcgcttaacgcgcttaacgggaagatgatcgtgccacagtccggcgtggtcctgtagttctggcttccgaagccgattagaccaaagagaaaggtcatctagaatgttattgattacaccattagttcttaggtttaggtctctgaagaccttggcattcctggagtcctcaatcttccataggatggtgactacacagtct

SEQ ID NO: 472 - DNA, 2065 bp, Aegilops tauschii
tgcaccgcttccaagtcctcccagcttgaccaactccactagcacttttgctgccacagccgaccagccatgaccctctcccgcagcggcgatggccagagtggctccgcgagggcgcacttcgtgctggtaccgatgatggctcagggccataccatccccatgaccgacatggcacgcctgctggcagagcatggcgcgcaggtccgcttcatcaccacgccggtcaacgccgctaggttggagggcttcgccgctgacgtgaaggcggcaggcctggcgggtcagctcgtggagctccacttcccgagtgtagagttcggcctaccagatgggtgcgagaacctcgacatgatccaatcaaagaatttgttcttgaacttcatgaaggcctgtgccgcgctgcatgagccgctcatggcgtacctccgtgagcagcagcactcgcctcctagctgcatcatatctgacatggcgcactggtggaccggtgacatcgcaagggagctcggcatcccgaggctcacctttagtggcttttgtggcttctcgtcccttgtcaggtacatcatttttcacaacaatgtattggagcatgtcacagatgacaatgagctcatcacgatcccggggttccctacaccgctagagttgacgaaggctaagttgcctggtggaaccctttgtgttccgggtatggagcaaatccgtgagaagatgtttgaggaggagctgagatgcgatggtgagatcactaatagcttcaaagagctcgagacattgtacattgaatcctatgagcagataacaaggaagaaggtctggacgatcgggccaatgtgcctctgccaccgaaacagcaacagaacggccgcaagaggaaacaaggcgtcaatggatgaggcacagtgcttgcaatggcttgattcaaggaagccaggctcagtgatctttgtgagttttggaagcctcgcttgcactacacctcaacaacttgttgaactgggactgggacttgaagcctccaagaaaccgtttgtttgggtgattaaagcaggagctaagcttccagaagtcgaggaatggctcgcagatgggttcgaggagcgtgtcagagacagaggtctgatcataaggggctgggcgccacaagtgatgatcctgtggcaccaagccgttggaggatttgtgacgcactgtgggtggaactcaacaatagagggcatctgtgcaggtgtgcccatgatcacatggccacactttgcagagcagtttttgaatgagaagctggtggtggatgtgctgaaacttggggtagaggttggagtgcaaggagttacacactgggtaactgaacaacaagaggttatggttaccagagatgctgtggagacagcagtgaacaccctgatgggtgaaggggaggctacagaggagttgagaatgagagcaaaagactgcgccattaaggcaaggagggctttcgacgaggaaggttcttcttacaacaacgtaaggctgttaattcaagaaatgagtaacaagacgaatgcatgtggttgatagagattacctaagctcgctttttcggtgtaaacatgaagtgaaagatcctagaatacatatatcatcatatagaattttgtaccaggctcacaggtgattatttagagattatagatgatccaaatgaagggaatatcaattatcatctgtattatgtacgctctttcatggcagtccacataacaactacacagtctgctcttctagatggttacttttcccttgcattttgtgaccgctgcacgactagccacggctcgtggaggcgtaggacaatgactcccacgacggtgccgccggcgccaagcaccgtcccatgggagcaacttgggagggacgccgccgtgcaccggacactgcgctgttggattgcaccaggcactgtacatggcctaataacagacctaatagctgcggtcttgtattgaattcttttttttagggggtattaaattctttctacatatacagtttattcggtctgtgtgcatgaagcaaa

SEQ ID NO: 473 - DNA, 2410 bp, Triticum aestivum
cgtctgccttccacaggcttgagaatcgagtagcaccacgcgtataccggtatacggcaagtcagcatcatccgggcagccaaattcagtgcatcgaatggcgtgctcttcttgacctgcgccatcatccggaccgcctggacgccgcctttctggaggggttcagaacttgggaagattcaattcatctacatggccgactccacgagtccatggctaacgttagagcatgcgtcactggcaagaggtgaccaagttgatacgctgcactcgttccgacgtcagctcctcaactcaacttaggaagatatatatagcaccaggaccaggtgctatatacgaacacactacggttgccattgcaccgcttccaagccctcccagcttgacagactccactagcacttcagccgatcagccatgaccttcgccggcagcggtgatggccagagcggctctgcgagggcgcacttcgtgctggtacccatgatggctcaaggccgtaccatccccatgaccgacatggcatgcctgctggcagagcatggcgcgcaggtcagcttcatcaccacgccggtcaacgccgctaggttggaaggcttcgccgctaaggtggaggcggcgggcctggtggttcagctcgtggagctccacttcccgagtgtagagttcggcctaccagatgggtgcgagaacctcgacatgatccaatcaaagaatttgttctttaacttcatgaaggcatgtgccgcgctgcatgagccgctcatggcgtacctccgtgagcagcagcgctcccctcctagctgcatcatatctgacatggcgcactggtggaccggtgacatcgcaagggagctcggcatcccgaggctcacctttagtggcttttgtggcttctcgtcccttgtcaggtacatcgtttttcacaacaatgtattggagaatgtcacagatgacaatgagctcatcacgatcccggggttccctacaccgctagagttgacgaaggctaagttgcctggaaccctttgtgttccgggtatggagcaaatccgtgagaagatgtttgaggaggagctgagatgcgatggtgagatcaccaatagcttcaaagagctcgagacattgtacattgaatcctatgagcagataacaaggaagaaggtctggacgatcgggccaatgtgcctctgccaccgaaacagcaacagaacggccgcaagaggaaacaaggcgtcaatggatgaggcacagtgcttgcaatggcttgattcaaggaagccaggctcagtgatctttgtgagttttggaagcctcgcttgcactacacctcaacaacttgttgaactgggactgggacttgaagcctccaagaaaccatttgtttgggtgattaaagcaggagctaagcttccagaagtcgaggaatggctcgcagatgggttcgaggagcgcgtcaaagacagaggtctgatcataaggggttgggcaccacagctcatgatcctgcagcaccaagccgttggaggattcgtgacgcactgcgggtggaactcaacaatagagggcatctgtgcaggtgtgcccatgatcacatggccacactttggggagcagtttttgaatgagaagctgctggtggatgtgctgcaaatcgggatggaggttggagtgaaaggagttacacagtggggaagtgaaaaccaggaggttatggttaccagagatgctgtggagacagcagtgaacaccctgatgggtgaaggggaggctacagaggagttgagaatgagagcagaagactgcgccattaaggcaaggagggctttcgacgaggaaggttcttcttacaacaacgtaaggctgttaattcaagaaatgggaaacaagacgaatgcatgtggttgatagagattacctaagctcgctttttcagtgtaaacatgaagtgaaacatcctagagtacatatatcatcatatagaattttgtaccaggctcacaggtgattatttagagattatagatgatccaaatgaagggaatatcaattatcctctctattatgtacgctctttcatggcagtccacataacaactacacagtctgctattctagatggttacgctctcccttgcattttgctaccgctgcacgactagccacggttcgtggaggcgtaggacaatgactccgagcaactagggaggggcgccgccgtgcaccggacactgcgctgttgcattgcaccaggcactgtacatggcctaataacagaccttgtttcattgctaatcgctgcggtcttgtattaaatccttttttagggggtattaaattctttctagatatggagtttattaggtctgtgtgcatgaagcaaagtgaaaacaggagcctcggtcgt

SEQ ID NO: 474 - DNA, 1945 bp, Aegilops tauschii
atatagcaccaggtgctatatacacacaacggttgccattgcaccgcctccaagccctcccagcttgacaaactccactagcacttttgctgccacagccgatcagccatgacctttgcaggaagcggcgatggggagagcggctccgagagggcgcacttcgtgctggtaccgatgatggctcagggccataccatccccatgaccgacatggcacgcctgctggcagagcatggcgcgcaggtcagcttcatcaccacgccggtcaacgccgctaggttggagggcttcgccgctgaccggcaggcggcgggcctggcggttcagctggtggagctccacttcccggcagcggagtttggcctaccggacgggtgtgagaacctcgacatgatccaatcaaagaatttgttcctgaacttcatggagacctgtgccgcgcttcaggagccgctcatggcatacctccgtgagcagcagcgctcgcctcctagctgcatcatatctgacatgatgcactggtggaccggcgacatcgcaagggagctcggcatcccgaggctcaccttcagtggcttttgtggcttctcgtcccttgtcaggtacaaacataaaaaggcaaaccttcaaatccgtgagaagatgtatgaggaggagctgagatgtgatggtgagatcactaatagcttcaaagagctcgagacattgtacattgaatcttatgagcagatagcaaggaagaaggtctggacgatcgggccaatgtgcctctgccaccgaaacagcaacacaacggccgcaagaggaaacaaggcgccaatggatgaggcacagtgcttgcaatggcttgattcaaggaagccaggctcagtgatctttgtgagttttggaagccttgcttgcactacaccacaacaaattgttgagctgggactgggactcgaagcctccaagaaaccgtttatttgggtgatcaaagcaggacctaagtttccagaagtcgaggaatggctcgcagatgggttcgaggagcgtgtcaaagacagaggcatgatcataaggggctgggcgccacaggtgatgatcctgtggcaccaagccattggaggatttgtgacacactgtgggtggaactcaacaatagagggcatctgtgcaggtgtgcccatgatcacatggccacactttgcagagcagtttctgaatgagaagctggtggtggatgtgctgaaacttggggtagaggttggagtgcaaggagttacacagtggggaagtgaacaacaagaggttatggttaccagagatgctgtggagacagcagtgaacaccctgatgggtgaaggggaggctacagaggagttgagaatgagagcagaagactgcgccattaaggcaaggagggctttcgacgaggaaggttcttcttacaacaacgtaaggctgttaattcaagaaatggaaaacaagacgaatgcatgtggttgatagagattacctaagctcgctttttcggtgtaaacatgaagtgaaacatcctagagtacatatatcatcatatagaattttgtaccaggctcacaggtgattatttagagattatagatgatccaaatgaagggaatatcaattatcctctctattatgtacgctctttcatggcagtccacataacaactacacagtctgctattctagatggttacgctctcccttgcattttgctaccgctgcacgactagccacggttcgtggagacgtaggacaatgactccgagcaactagggaggggcgccgccgtgcaccggacactgcgcttttgcattgcaccaggcactgtacatggcctaataacagaccttgtttcattgctaatcgctgcggtcttgtattaaatcctttttttagggggtattaaattctttctagatatggagtttattag

SEQ ID NO: 475 - DNA, 2710 bp, Aegilops tauschii
aggatacagaccatacagagtaatctttgactagactaatatggtcgaaaaacaggcaagaaaattccacacgctgtcacagtacactgaatctccacatggaaaataatgcactcctgtcatattattggcagagccagctggctctgccttccacaggccacaggcttgagagttgagtagcaccacgcatatacggcaagtcagcatcagagttgaacatcatccgggcagccaaattcagtgcatcgaatccgggtgccagggattaatctgcgccatccgatgtcccatcggaccgcctggagccctggacgccgccttcctggaggttcagaacttgagaagattcattcatccacatggccgactccatgagtccatggctgatgttagagcatgcgtcactagcaagaggtgaccaagttgatacgctgcacccgttccaacgtcagctcgtcaactcaacttaggaagatatatagcaccaggaccaggcgctatagacacactacagctgccattgcaccgcttccaagtcctcccagcttgacagactccactagcacttttgctgccacggccgatcaaccatgaccttcgcaggaagcggctatggggagaggggctccaagagggcgcacttcgtgctggtaccgatgatggctcagggccataccatccccatgaccgacatggcacgcctgctggcagagcatggcgcgcaggtcagcttcatcaccacggcggtcaacgccgctaggttggagggcttcgccgctgacgtgaaggcggcaggcctggcgggtcagctcgtggagctccacttcccggcagcggagttcggcctaccggacgggtgcgagaacctcgacatgatccaatcaaagaatttgttcttgaacttcatgaaggcctgtgccgcgctgcaggagccgctcatggcgtacctccgtgagcagcagcgctcgcctccgagctgcatcatatctgacctggttcactggtggactggtgacatcgcaagggagcttggtatcccgaggctgacctttagtggcttttgtggcttctcgtccctcatcaggtacatcacttatcacaacaatgtatttcaaaatgtcaaagacgaaaatgagctcatcacaatcacagggttccctacgccactagagctgacaaaggctaaatgccctggaaatttttgtattcctggtatggagcaaatccgtaagaagttccttgaagaggagctgaaaagtgatggtgaggtaattaacagcttccaggagctggagacattgtacattgaatcctttgagcagacgacaaagaagaaggtctgggcggtcggaccaatgtgcctctgtcaccgagacaacaacactatggccgcaagaggaaacaaggcgtcaatggatgaagcacagtgcttgcaatggcttgattcaatgaagccaggctcagtggtctttgtcagctttggcagcctcgcttgcactacacctcaacagcttgttgagctgggactgggacttgaaacctccaggaaaccgtttatttgggtgatcaaagcaggagctaagcttccagaagtcgaggaatggctcgcagacgagttcgaggagcgtgtcaaaaatagaggcatggtcataaggggttgggcgccacagctcatgatcctgcagcaccaagccgttggaggattcgtgacgcactgcgggtggaactcaacaatagagggcatctgtgcaggtgtgcccatgatcacatggccgcactttggggagcagtttttgaatgagaagctgctggtggatgtgctgaaaatcgggatggaggttggagtgaaaggagttacacagtggggaagtgaaaaccaggaggttatggttacaagagatgaggtgcagaaagctgtgaacaccctgatggatgagggcgcggctgcagaagagatgagggtgagagcaaaagactgcgccattaaggcaaggagggctttcgatgagggaggttcttcgtatgacaacataaggctattaattcaagaaatggaaatcaagacgaatgcatgtggttcagtggttgatagagatggtaataagctctcttttttggtgtaaacaaaaagtaaaagagcctatagcatatttatcgttataaaggatttcttttacaaataaccagtagcttgtatcaggatcactatctattctgttgcgcaggtttcatattttttggggaaaggggatatccccggcctctgcatcatactgatccacacactcatatttattaaaaacaattcagaagttcagtagtttcataatgattacactgtctacttctccaagtggcatgctctacttttcattttgctaccacttactcatcagagttgataagagttcagaaaggagaaaaaatgaaataaaatgtatgcacattatcaaaactaagactaaaagcaagcgatgattcaaggtgaataatccaaagaaagataaggaagtgaaacccacataaagcacatactccctccgtccggaaatacttgccatcaaaatgaataaaaggggatgtatctagacgtattttagttctagatacatccctttttatccattttgatgacaagtattttcggacggagggagtatgaatttagaaagttatgtttgacctagcagtgtgacaaacatgaaat

SEQ ID NO: 476 - DNA, 1835 bp, Triticum aestivum
ctcaacttcacctcgtgatatattactcaccacggttgccattgcaccgcttccaagtcctcccagcttgacaaactccactagcacttttgctgccacagccgattagccatgaccctctccggcagcggcgatggccagagcggctccgtgagggcgcacttcgtgctggtgccgatgatggctcagggccataccatccccatgaccgacatggcacgcctgctggcagagcatggcgcgcaggtcagcttcatcaccacgccggtcaacgccgctaggttggagggcttcgccgctgacgtgaaggcggcgggcctggcggttcagctcgtggagctccacttcccggcagcggagttcggcctaccggacgggtgtgagaacctcgacatgatccaatcaaagaatttgttcttgaacttcatgaaggcctgtgccgcgctgcaggagccgctcatggcgtacctccttgagcagcagcgcttgcctcctagctgcatcatatctgacatggtacactggtggaccggtgacatcgcaagggagctcggcatcccgaggctcacctttagtggcttttgtggcttctcgtcccttgtcaggtacatcacttatcacaacaatgtatttcaaaatgtcaaagacgaaaatgagctcatcacaatcacagggttccctacgccactagagctgacaaaggctaaatgccctggaaatttttgtattcctggtatggagcaaatccgtaagaagttccttgaagaggagctgaaaagtgatggtgaggtaattaacagcttccaggagctggagacattgtacattgaatcccttgagcagacgacaaagaagaaggtctgggcggtcggaccaatgtgcctctgtcaccgagacaacaacactatggccgcaagaggaaacaaggcgtcaatggatgaagcacagtgcttgcaatggcttgattcaatgaagccaggctcagtggtctttgtcagctttggcagcctcgcttgcactacacctcaacagcttgtagagctgggactgggacttgaaacctccaggaaaccgtttatttgggtgatcaaagcaggagctaagcttccagaagtcgaggaatggctcgcagacgagttcgaggagcgtgtcaaaaatagaggcatggtcataaggggttgggcaccacagctcatgatcctgcagcaccaagccattggaggattcgtgacgcactgcgggtggaactcaacaatagagggcatctgtgcaggtgtgcccatgatcacatggccgcactttggggagcagtttttgaatgaggagctgctggtggatgtgctgaaaatcgggatggaggttggagtgaaaggagttacacagtggggaagtgaaaaccaggaggttatggttacaagagatgaggtgcagaaagctgtgaacaccctgatggatgagggagtggctgcagaagagatgagggtgagagcaaaagactgcgccattaaggcaaggagggctttcgatgagggaggttcttcgtatgacaacataaggctattaattcaagaaatggaaatcaagacgaatgcatgtcgttcagtggttgatacagatggtaataagctctcttttttggtgtaaacataaagtaaaagagcctatagcgtatttatcattataaaggatttcttttacaaacaaccggtagcttgtatcaggatcactgtctattctgttgcgcagatttcatatttttgggaaaggggatatccccgacctctgcatcatactgatccacacagccatatttattaaaaacaatcagaagttcg

SEQ ID NO: 477 - DNA, 2068 bp, Triticum aestivum
gggattaatctgcgccatcggatgtcccatcggaccgcctggagccctggacgccgccttcctggaggttcagaacttgagaagattcattcatccacatggccgactccatgagtccatggctgacgttagagcatgcgtcactggcaagaggtgaccaagttgatacgctgcacccgttccaacgtcagctcgtcaactcgacttaggaagatatagcaccaggtgctatatacacacaacggttgccattgcaccgcttccaagtcctcccagcttgacagactccactagcacttttgctgccacggccgatcaaccatgaccttcgcaggaagcggctatggggagaggggctccaagagggcgcacttcgtgctggtaccgatgatggctcagggccataccatccccatgaccgacatggcacgcctactggcagagcatggcgcgcaggtcagcttcatcaccacggcggtcaacgccgctaggttggagggcttcgccgctgacgtgaaggcggcaggcctggcggttcagctcgtggagctccacttcccggcagcggagttcggcctaccggacgggtgcgagaacctcgacatgatccaatcaaagaatttgttcttgaacttcatgaaggcctgtgccgcgctgcaggagccgctcatggcgtacctccgtgagcagcagcgctcgcctccgagctgcatcatatctgacctggttcactggtggactggtgacatcgcaagggagcttggtatcccgaggctgacctttagtggcttttgtggcttctcgtccctcatcaggtacatcacttatcacaacaatgtatttcaaaatgtcaaagacgaaaatgagctcatcacaatcacagggttccctacgccactagagctgacaaaggctaaatgccctggaaatttttgtattcctggtatggagcaaatccgtaagaagttccttgaagaggagctgaaaagtgatggtgaggtaattaacagcttccaggagctggagacattgtacattgaatcctttgagcagacgacaaagaagaaggtctgggcggtcggaccaatgtgcctctgtcaccgagacaacaacactatggccgcaagaggaaacaaggcgtcaatggatgaagcacagtgcttgcaatggcttgattcaatgaagccaggctcagtggtctttgtcagctttggcagcctcgcttgcactacacctcaacagcttgttgagctgggactgggacttgaaacctccaggaaaccgtttatttgggtgatcaaagcaggagctaagcttccagaagtcgaggaatggctcgcagacgagttcgaggagcgtgtcaaaaatagaggcatggtcataaggggttgggcgccacagctcatgatcctgcagcaccaagccgttggaggattcgtgacgcactgcgggtggaactcaacaatagagggcatctgtgcaggtgtgcccatgatcacatggccgcactttggggagcagtttttgaatgagaagctgctggtggatgtgctgaaaatcgggatggaggttggagtgaaaggagttacacagtggggaagtgaaaaccaggaggttatggtcacaagagatgaggtgcagaaagctgtgaacaccctgatggatgagggcgcggctgcagaagagatgagggtgagagcaaaagactgcgccattaaggcaaggagggctttcgatgagggaggttcttcgtatgacaacataaggctattaattcaagaaatggaaatcaagacgaatgcatgtggttcagtggttgatagagatggtaataagctctcttttttggtgtaaacaaaaagtaaaagagcctatagcatatttatcgttataaaggatttcttttacaaataaccagtagcttgtatcaggatcactatctattctgttgcgcaggtttcatattttttggggaaaggggatatccccggcctctgcatcatactgatccacacactcatatttattaaaaacaattcagaagttcagtagtttcataaaaaaaaaa

SEQ ID NO: 478 - DNA, 1718 bp, Secale cereale
aacacatcgtgctatcttgccggtgtcactgtcttcccagtttgactgactccaccaccagtgcttctgctacaatagcagatcagccatgaccttcaccggcagcggcgatggccagagcggctccgtgagggcgcactttgtgctggtaccgatgttggcgcaggggcacacaatccccatgaccgacatggcgcgcctgctggcagagcacggcgcgcaggttagcttcatcaccacaccagtgaatgcctccaggttggcaggctttgcagccgatgtggaggcggcgggcctggcagtacggctcgtggagctccatttcccgagcgccgagttcggcctaccggacgggtgcgagaacctggacatgatccactccacggatctgctccccaacttcatggatgccatcgctgcgcttcaggagccgctcaaggcatacctccgtgagcagcagcgctcgcctccgacctgcatcatatctgacctgattcactggtggactggtgacatcgcaagggaacttggtatcccgaggctgacctttagtggcttttgtggtcttctcgtccctcatcaggtacatcacttatcacaacaatgtatttcaaaatgtcaacgacgaaaatgagctcatcacaatcacagggttccctacgccaatagagctaacgaaggctaaatgccctggaaatttttccattcctggtatggagcaaatccgtaagaagttccttgaagaggagctgaaaagtgatggtgaggtcattaacaccttccaagagctggagacattgtacattgaatcctttgagcagaccacaaagaagaaggtctggacaaccggaccaatgtgcctctgccaccgagacaacaacactatggccgcaagaggaaacaaggcgtcaatggatgaagcacagtgcttgcaatggcttgattcaatgaagccaggctcagtggtctttgtcagctttggcagcctcgcttgcactacacctcaacagcttgttgagctgggactgggacttgaagcctccagaaaaccatttatttgggtgatcaaagcaggagctaaacttccagaagtcgaggaatggctcgcagacgggttcgagcagcgtgtcaaaaatagaggcatggtcataaggggttgggcaccacagctcatgatactgcggcaccaagccgttggaggattcgtgacgcactgtgggtggaactcaacaatagagggcatctgtgcaggtgtgcccatgatcacatggccgcattttggggagcagtttttgaatgagaagctggtggtggatgtgctgaaaattggggtcgaggttggagtggaaggagttacacagtggggaagtgaaaaccaggaggttatggttacaagagatgaggtgcagaaagctgtgaacaccctgatggatgagggggcggccgcagaagagatgagggtgagagcaaaagactttgccattaaggcaaggaaggcttttcatgagggaggttcttcatatgacaacataaggttattaattgaagaaatgggaaacaggacgaatgcatgtggttgatacttgatacagatggtagtaagctctctttgggtgcaaacataaataaagagcctatagtacaataacctgttgtcattagaagagcctatatgtcattggaataattattataataacccgctgcttgtatacgca

SEQ ID NO: 479 - DNA, 2998 bp, Hordeum vulgare
actaaataggtgatcccgactaacctgtttttcctcgatcctcaacatgcaaccatgaatggtaaaaatggccacctcaacatgtaatcatgcatggggaaactattatgataatcatatctattctcaaatctcgtgtgcgaggtatcgtctactccctccgtttctaaatataagtctttttagaaattttactataagactatatacgaagcaaaaataagtgaatgtacattctaaagtatgtctatatacattaatacgtagttccctagtgaaagctcgacttataacggagtgagtagttttttggagacgcaatgtctctcttagcaatggtctataagcaccaggcactgtacatggcctaataacagaccttgtttgattgctagttgccgcgggttatcttgtactgtagtatcaaattatttttagatatataattttttgggaaaagaaggaggctcggtcgtacctctgagtcaggaagtcactgtgttgattaggatgcattgcgtcgctccaaaaatggactcatattttccagatctgggccgtcgcagggtcggcagagtggttgcacgctcgtcggcggcgcggggaagaccggcgtccatggtggcgcggtggttggcccgacggatggtggcctgcaactttttttttagcttgatctttgactaagaataagacggtcgggaaaccgacaagagccatgcttgatcttccacccactgtcacagtacactgaatgactgaatctccacacagcaaataatgcaccatcatatatatgcagaatcggctggctcggccttccacagccttgggagttaagtagtatgcatatacaacaagtcagcatcagacatgaggatcatccaaatcatgtaaaaatgacacttctttgagcatgacaggcgttagcggtggttaatctgagccatacgatgtctgatctgatggcctggattctgacgattcagaacttaagaagattcatccacatggctgactccaggagtccatgactaacgtgagagcatgcgtcactagcaagaggtgaacaatttgatacgctgttgcatcgtcagctcatcaaattttccttagaaagatatagcatcaggtgctatatatacactatagtagccattgcgaccatcatcagattgtgtccaacagatcgtgccatcttgccggtgtcactgtgctcccagtttactcccagtttaactgactccaccaccagtacttctgctacaatagccgatcagccatgaccttcaccagcagcggcgatggccagagtggttccatgagggcgcactttgtgctggtaccgatgttggcgcaggggcacacaatccccatgaccgacatggcgcgcctgctggcagagcacggcgctcaggttagcttcatcaccacaccagtgaacgccgccaggttggcaggctttgcagccgatgtggaggcggcaggcctggcagttcggctcgtggagctctatttcccgagcaccgaattcggcctaccggatgggtgtgagaacctagacatgatccactccacggatctgctctccaacttcatggatgccatcgctgcgcttcaggagccgctcaaggcatacctccgtgagcagcagtgctcgcctccaagctgcgtcatatctgacctgattcactggtggactggtgacatcgcaagggaacttcgtatcccaagactgaccttcagtggcttttgtggcttctcgtccctcatcaggtatatcacttttcacaacaatgtatttgaaaatgtcaaagacgaaaatgagctcatcacgatcacggggttccctacaccactagagataacgaaggctaaatgcccgggaggtttttccattcctggtatggagcaaacccgtaagaagttccttgaagaggagctgaaaagtgatggcgaggtcactaacagctatcaagagctggaggcattatacattgaatcctttgagcagacaacaaagaagaaggcctgggcaatcggaccaatgtgcctctgccaccgagacaacaacactatggccacaagaggaaacaaggcgtcaatggatgaggcacagtacttgcaatggcttgattcaatgaagccaggctcggtggtctttgtcagctttggcagcctcgcttgcactacacctcaacagcttgttgagctgggactgggacttgaagcctccaggaaaccatttatttgggtgatcaaagcaggagctaagcttcccgaagtcgaggaatggctcgcagacgggttcgaggagcgtgtaaaaaacagaggcatggtcataaggggttgggcaccacagctcatgatcttgcggcaccaagccgttggaggattcgtgacgcactgtgggtggaactcaacaatagaggccatttgtgcaggtgtgcccatgatcacatggccgcactttggggagcaatttttgaatgagaagctggtggtggatgtgctgagaatcggtgtggaggttggagtgaaaggagttacatggtggggaaatgaaaaacaggagattgtggttacaagagatgaggtggagaaagctgtgagcaccctgatggatgagggggcggctgcagaagagacgagggtgagagcaaaagactgcgcgattaaggcaaggaaggcctttgatgagggaggttcttcatatgacaacataaggctactaattcaagaaatgggaagcaggacgaatgcatgtggttgatacagatggtagtaagttctcttttttggtgtaaacaaaaaataaaagagcctgtagtacaaataacatgttgtcattataaagagcctatatgtcattggaaataattttaattattttacaaatagcccgctgcttgtattaggctcgctgttggggtcgcgattgtttagagattaaacgaggatccgaatgacagcaatatcaattgtttacgctgctgtg

SEQ ID NO: 480 - DNA, 1968 bp, Triticum aestivum
cgtgagagcatgcgtcactggcaagaggtgaccaatttgatacgctgttgcatcgtcagctcatcatctttccttaggaagacatagcactaggtgctatatgtatacactacagttgccattgcgaccatcatcagattgtgcccaacacatcgtgctatcttgccggtgtcactgtcttcccagtttgactgactccaccaccagtgcttttgctacaatagccgatcagccatgaccttcaccggcagcggcgatggccagagcggctccgcgagggcgcactttgtgctggtaccgatgttggcgcaggggcacacaatccccatgaccgacatggcacgcctgctggcagagcacggcgcacaggttagcttcatcaccacaccagtgaatgcctccaggttggcaggctttgcagccgatgtggaggcggcgggcctggcagtacggctcgtggagctccatttcccgagcgccgagttcggcctaccggacgggtgcgagaacctggacatgatccaatccacggatctgctctccaacttcatggatgccatcgctgcgcttcaggagccgctcaaggcatacctccatgagcagcagcgctcgcctccgagctgcatcatatctgacctgattcactggtggactggtgacatcgcaagggagcttggtatcccaaggctgacctttagtggcttttgtggcttctcgtccctcatcaggtacatcacttatcacaacaatgtatttcaaaatgtcaaagacgaaaatgagctcatcacaatcacagggttccctacgccactagagctgacaaaggctaaatgccctggaaatttttgtattcctggtatggagcaaatccgtaagaagttccttgaagaggagctgaaaagtgatggtgaggtaattaacagcttccaggagctggagacattgtacattgaatcctttgagcagacgacaaagaagaagatctgggcggtcggaccaatgtgcctctgccaccgagacaacaacactatggccgcaagaggaaacaaggcgtcaatggatgaagcacagtgcttgcaatggcttgattcaatgaagccaggctcagtggtctttgtcagctttggcagcctcgcttgcactacacctcaacagcttgtagagctgggactgggacttgaaacctccaggaaaccgtttatttgggtgatcaaagcaggagctaagcttccagaagtcgaggaatggctcgcagacgagttcgaggagcgtgtcaaaaatagaggcatggtcataaggggttgggcaccacagctcatgatcctgcagcaccaagccgttggaggattcgtgacgcactgcgggtggaactcaacaatagagggcatctgtgcaggtgtgcccatgatcacatggccgcactttggggagcagtttttgaatgagaagctgctggtggatgtgctgaaaatcgggatggaggttggagtgaaaggagttacacagtggggaagtgaaaaccaggaggttatggttacaagagatgaggtgcagaaagctgtgaacaccctgatggatgagggggcggctgcagaagagatgagggtgagagcaaaagactgcgccattaaggcaaggagggctttcgatgagggaggttcttcgtatgacaacataaggctattaattcaagaaatggaaatcaagacgaatgcatgtggttcagtggttgatacagatggtaataagctctcttttttggtgtaaacataaagtaaaagagcctatagcatatttatcgttataaaggatttcttttacaaataaccagtagcttgtatcaggatcactatctattctgttgcgcaggtttcatattttttgggaaaggggatatccccggcctctgcatcatactgatccacacacccatatttattaaaaataattcagaagttcagtagtttc

SEQ ID NO: 481 - DNA, 2449 bp, Brachypodium distachyon
ggatcgacttaagagttctgcacggtttggatctcaagaagcttcatccacatgccaaattgcttctagagttcaggctccacgagaccacgtgtacagaactgatggcgtgtgagcatgcgtcatttccgctgcattattgcatttgaatcatctgcttgtaaacttcccctgatcaagtaccaggacggcaggaccaggtgccatatgtacaccgctgccgccacagggacctacagtagctcaatatcccatatcgcatcgtgccggcgttgctgtccagctccgggcttcaccaccttcgctaccacttcagccatgacctttgccaacggcgaggagagcggccgcgcaagggcgcactttgtgcttgtcccgatgatggcgcagggccacaccattcccatgaccgacatggcccgcctgctggctcagcacggtgcgcaggtcagcatcatcaccacgcctgtgaacgcctccaggttagcgggcttcattgctgacgtggatgcggcgggcctggcggtccagctcgtgcagctccgcttcccggccgtggagttcggcctaccggacgggtgcgagaacctagacttggttcagtccagtgatctgctcgtgaacttcttggatgcctgcggcgcgctccgggaaccgcttgcagcgctcctccgtgaacagcagcacccgcctccgagctgcataatatccgacgtgatgcactggtggactggtgacattgcaagggagctcggtatccccaggctcgcctttattggattctgtggcttctcgtctcttgccaggtacatcatttttcaccacaaagtattcgaagacgtcacagacgagaacgagctcatcaccatcccgggattccctacgccactggagttgacaaaggctaaatcccctggaggcattgtcattcccggtattgagagtatccgtgataagatcttagaggaggagctgagatgtgatggtgaggtcatgaacagcttccaagagctggagactttgtacattgaatcctttgagcagatgacagggaagaaggtctggacggtcgggccaatgtgcctctgcaaccaagacagcaacacaatggctgcaagaggaaacacggcatcaatggatgaggcacagtgcttgcaatggcttgattcaatgaagccaggctcagtgatctttgtcagctttggcagccttgcctgtactgcacctcagcaacttattgagctgggactgggacttgaagcctccaagaaaccatttatttgggtaatcaaagcaggggataagtttccagaagtcgaggaatggcttgcagatgggtttgagaagcgtgtcaaagacagaggcatgatcataaggggctgggcaccacaggtgatgatcctgtggcaccaagcaattggaggattcatgacacactgcggatggaactcaacaatagagggcatctgtgcgggtgttcccatgatcacgtggccacactttgcagagcagtttttgaatgagaagctactggtggatgtgttgaaaactggggtcgaggttggagtgaaagaagttacacagtggggacaagaacacaaagaggttatggttacaagaaatgctgtggaaaaagcagtatgcaccgtgatggatgagggggaggctgcagaggaattgaggatgagagcaaaggactatgccatcaaggcgaagagggctttcagtgaggaaggctcttcatataacaatgtaaggctgttgattcaagaaatgggaaacaggacaaatgcttggggtgtaaacataaagtgaaagaccccacaaatacttgtagtagcatttcttttacaaataaccagaatcttgtatctggctcattggggggttaggttgagattagacgtggtccgaatggcagaaatatcggctgtcagcactgctttgcaggtttcatggaatcatggcagtcgaccaaatgtttacatgacctgcttttcaagatgttatgctctcctttgcattgtgctgccacatgctcatcagtgttcataagaattggaaaaggagaaaatacggaataaaatgtttgcgtactatggaaaccgtcacaaaaagcaatgattcgaggtgaatagtccaaaggaagagaaagatttggaaccagcataaagcgcatttgaaattagaagcttctgtttaacctaatagtgcggcaaacatgaaactataaggatctcccccatcctaaaaaagagggtcaaggtcaccttgtcctgttaatatgaaaacaaatagttgaaggatcagtctcaaggctaatgaagaaatcatttgtgttcaatgtgctgcttaatttccctggtagtgaaaatcctgctaaacatgtgctttagtcttctaaactatatttgggataaaagtatgtatttaaaaagcgactttggta

SEQ ID NO: 482 - DNA, 1991 bp, Aegilops tauschii
catggctgactccacgagtccatgactgacgtgagagcatgcgtcactggcaagaggtgaccaatttgatacgctgttgcatcgtcagctcatcatctttccttaggaagacatagcactaggtgctatatgtatacactacagttgccattgcgaccatcatcagattgtgcccacacatcgtgctatcttgccggtgtcactgtcttcccagtttgactgactccaccaccagtgcttctgctacaatagccgatcagccatgaccttcaccggcagcggcgatggccagagcggctccgcgagggcgcactttgtgttggtaccgatgttggcgcaggggcacacaatccccatgaccgacatggcacgcctgctggcagagcacggcgcgcaggttagcttcatcaccacaccagtgaatgcctccaggttggcaggctttgcagccgatgtggaggcggcgggcctggcagtacggctcgtggagctccatttcccgagcgccaagtttggcctaccggacgggtgcgagaacctggacatgatccaatccacggatctgctctccaacttcatggatgccatcgctgcgcttcaggagccgctcaaggcatacctccatgagcagcagcgctcgcctccgagctgcatcatatctgacctgattcactggtggactggtgacatcgcaagggagcttggtatcccgaggctgacctttagtggcttttgtggcttctcgtccctcatcaggtacatcacttatcacaacaatgtatttcaaaatgtcaaagacgaaaatgagctcatcacaatcacagggttccctacgccactagagctgacaaaggctaaatgccctggaaatttttgtattcctggtatggagcaaatccgtaagaagttccttgaagaggagctgaaaagtgatggtgaggtaattaacagcttccaggagctggagacattgtacattgaatcctttgagcagacgacaaagaagaaggtctgggcggtcggaccaatgtgcctctgtcaccgagacaacaacactatggccgcaagaggaaacaaggcgtcaatggatgaagcacagtgcttgcaatggcttgattcaatgaagccaggctcagtggtctttgtcagctttggcagcctcgcttgcactacacctcaacagcttgttgagttgggactgggacttgaaacctccaggaaaccgtttatttgggtgatcaaagcaggagctaagcttccagaagttgaggaatggctggcagacgagttcgaggagcgtgtcaaaaatagaggcatggtcataaggggttgggcaccacagctcatgatcctgcagcaccaagccgttggaggattcatgacgcactgcgggtggaactcaacaatagagggcatctgtgcaggtgtgcccatgatcacatggccacactttggggagcagtttttgaatgagaagctgctggtggatgtggtgaaaatcgggatggaggttggagggaaaggagttacacagtggggaagtgaaaaccaggaggttatggttacaagagatgaggtgcagaaagctgtgaacaccctgatggatgagggggcggctgcagaagagatgagggtgagagcaaaagactgcgccattaaggcaaggagggctttcgatgagggaggttcttcgaatgacaacataaggctattaattcaagaaatggaaatcaagacgaatgcatgtggttcagtggttgatacagatggtaataagctctcttttttggtgtaaacataaagtaaaagagcctatagcatatttatcgttataaaggatttcttttacaaataaccggtagcctgtatcaggatcactgtctattctgttgcgcaggtttcatatttttttgggaaaggggatatccccggcctctgcatcatactgatccacacagccatatttattaaaaacaattcagaagttcagt

SEQ ID NO: 483 - DNA, 4469 bp, Brachypodium distachyon
tagtccactactgctaggctgcttgcttctcaacgctgttagaagatttaatgtactactgtaatccctagaatctctacgtctgggcagaatcctcgcgctctcagcgctctgaggctttccgcgcgtgtgtttgggccgtcttgtcagcgaggctggggtctgacggtttgcttcgcgtacgtgtcgtcggctcgttgctcgtgggtcggttcgagggggcacctggtgggcttcgtgagctttcgcctggccgtctcttgccgtctctttgctcgtgtttctttttttcgtctctttccttcagcaaggggccctcctctgccgattcctcgctgctcgcggttgttgcgccgccggctgctgctgctcttcttgcctcccgtcttgttgtgcgctgctgcttccattgttttctcccttccatccggtggtctgcgccgcaggttgtgctggtgggagttgttcgttcggtgtggtcctcttcgtctgttcgtgtctctcgtgctgctggttgctgttcgctaggaaagggggagccctagatgcgccgcgccgccagcatctcccatggccgatgctccttccatggcgcctgcacccgcctcccgtctgtaaggggtagatcctcccccggcgccgagatcgacgacactcccgcaccacgcgtcgtcttcaggtcatccagactgcttaatgggagctgaattgttaagagttgtggtgaatagtaatactaatgtaaaatgaattccattcaccgtgttgtcatcttcttcagagggacagcctgaaagcattgtccaggacattgaaaatatgatgcacctacacattgataagccagactgaatcaggggcggagggagcacccaggctagcacgggctctggccccctctaatatttggaatttgtacttgaccctcctcataacctttgcaattttatcctataagtttcagtttttatgcttcggcccgaccaataaatcatctattctagccctccctatgtttttttcctccctccgcccttgacatgaattaacaaggagatatagatatccaacggggataagattattaagacgcaagaccgccgcgcaacgatggtgatggaggaggtcaacgcctcaacggtacgtggatgccaaggaattaggaaacggtgagtgaacgccaaggagcactgctcccgccatctgtgtcgctccaaaatggtctcctttttcccccgaatcaggtggaagttctttccatgcagaagcttctcacttgtaaaagtctgaaaagatacagacattaaccttattatatacccagtatgctaaaaaaaaccttatgtacccagtaatctttgacttgaagagtaatacgtccaaaaagcgaacaagaaaaattccaccgtcttcaccagttactttgctgcgttgaatcttccgtacagaaaatcatgcagccaacgcaagcacacattattggcacttggcagaatgagttggatgatcagagttaatcaagagtcagtgcatcgagttgtgtattacattgagaagcaagcagtagtggaccagagttcacaatcatcctcttgggcagctgaagtcagtgcatacgaatcctgcaaaagacccttgactcttaagccaaggaggtagtacgggttgatctgggccatccattatcccgatcggacagcctggaccaacttcgcctttggcacggttatctcaagaagcttcatccaaattgcttttagagctcggttgtgacgtgtcagcgtgcatcactggaggaagtgaccaagttgattacgctgctgccagtgcactccttgcctgattgcaattgaatcgtcagctcgtcaacttcccctgaagtaccaggaccaggtgccatatgtacaccgctgtcgccactgcaacctagctcattaccccatatcgacatatcgcatcttcctggcttgactcacttcaccaccttcactgccagacagccatgaccttcgtcagcagcgggcagagcgaacccccgagggcgcacttcgtgctggtcccgatgatggcgccaggccactccattcccatgacggacatggcccgcctgctggctgaacacggtgcgcaggtcagcttcatcaccacaccggtgaacgcgtccaggttagcgggcttcattgcagacgtggatgcagcgggcctggcggtccagcttgtgcagctccgcttcccaactgccgagttcggcctaccggacgggtgcgagaaccttgacttggtccaatccagggatctgctcttgaacttcatggaggcctgtgccgcgctccgggaaccgctcgcagcgcacctccgtgagcagcagcacctgcctccgagctgtataatatccgacatgatgcactggtggaccggtgacattgcaagggagctcggtatccccaggctcgcctttattggattctgtggcttctcgtcccttgccaggtacattgcttttcaccacaaagtattcgaagacgtcacagatgagaacgaactcatcacaatcccgggattccctacgccactggagttgacgaaggctaaatcccctggaggcatagtcattcccggtttggagcgtatccgtgagaagatcttagaggaggatctgagatgcgaaggcgaggtcctcaacagtttccaagatctggagactttgtacattgaatcctttgagcagatgacagggaagaaggtctggacggttgggccaatgtgcctctgcaaccaagacagcaacacaatggctgcaagaggaaacaaggcgtcaatggatgaggcacaatgcttgcaatggcttgattcaatgaagcctggctcagtgatcttagtcagctttggcagcctcacctgtactgcacctcagcaacttattgagctgggactgggacttgaagcctccaagaaaccgtttatttgggtgatcaaagcaggagataagtttccagaagttgagggatggctcgccgacgggttcgaggagcgtgtcaaagacagaggcatgatcataaggggctgggcaccacaggtgatgatcctgtggcatcaagcaattggaggattcatgacacactgtgggtggaactcaacaatagagggcatctgtgcaggtgttcccatgatcacgtggccacactttggagagcaatttttgaatgagaagctactggtggatgtgctgaaaattggggtcgaggttggagtgaaacgagttacacactggggacaagaacaaaaagaggttatggttacaagaaatgctgtggaaaaagcagtgtacactgtgatggatgacggggaggctgcagaggagttgaggatgagagcaaaagactacgccatcaaggcgaagatggctttcaatgaggaaggttcttcatacaacaatgtaagtctgttgattcaagaaatgagaaagaggacaaatgcatctgcttgatacagatggtagtaggctctcccttggggtgtaaacataaagtgaaagacccgataaatatttgtagcatttattttacaaataaccagtagcttgcatcaggctcgctatggggttcggttgagattagacgtggtccaaatggcagcaatatcggttgtctgcaatgctgcgcaggtttcatggtagtctacctatgattgcatgatctgcttttctagacgctctcctttgcattgtgctgccatatgctcatcagttcataagattttgaaaaaaacaaaacggggaataaaatgtatgcatactatggaaacggacacagatggcaatagatgattcgaggtgaatagttcaaaggaagagaaggaagtttaaccagcataaagcacatatgaaattagaagcttctgtttgacataatagtgcgtcaaactttgaaactataaggatctccccattctaaaagaacgttcaaggtccacctaatccacctaacacaaggtcgtcttgtcatgttaatatgaaaataaatagttgaaggatcagactctagaatagtgagaaaatcaattgtttagccaaatccttctaaatatgtgatttagtcttctaaagtctaaagttatgtatttaaaaagcggctctgggcacaaataggtgtgaataacttcaaagaaaccatggtgcaataaaagtatatgaatagaatgactgacccatcagatgtgccaagatttactcaactatgaacaaggatggaattaaaataccctatgttcaaagtaggcgaatattttcagtttataaatataattcaaatagcaactagtcgacaggaacgggatcaaatatatgaaaactgcagactggaggggacagaacaaacctggttttactaagcagtaaacagcacagcttgaccggacatcaatcattgattaaccaggtgattgatagaacatggttgcaccgaaataat

SEQ ID NO: 484 - DNA, 1836 bp, Triticum aestivum
acactatagttgccattgtgaccatcatctgattgtgtccagcagatcatgctatcttgccagtgtcactgttctcccagtttgactgactccatcaccagtacttttgctacaacagccgattagccatgaccttcacgggcagtggcgatggccagagcggctccatgagggcgcactttgtgctggtaccgatgttggctcaggggcacaccatccccatcaccgacatggcgcgcctgctggcagagcacggagcgcatgtcagcttcatcaccacgccagtgaacgcctccaggttggcaggctttgcagccgatgtggaggcgtcgggcctggaagttcggctcatggagctccatttcccgagcgccgagttcggcctaccggacgggtgcgagaacctagacatgatccaatccacggatcttctccccaacttcatgtatgccatcgctatgcttcaggagccgctcaaggcatacacggatgagcagcagtgctcgcctccgagctgcatcatatctgacctgattcactggtggactggtgacatcgcgagggagcttggtatcccgaggctgacctttagtggcttctgtggcttctcgtctcttgcaggtacatcacttttcacaataatgtatttgaaaatgtcaaagacgaaaatgagctcatcacgatcaggcgtttccctacaccactagagctgacgaaggctaaatgcccgggaaatctttccattcctggtatggagcaaatccgtaagaagttccttgaagaggagctgagaagtgatggtcaggtcattaacagcttccaagaactggagacattgtacattgaatcctttgagcagaccacaaagaagaaggtctgggcaattggaccaatgtgcctctgccaccaagacaacaacactatggccgcaagaggaaacaagacgtcaatgggtgaggcccagtacttgcaatggcttgattcaatgaagccaggctcagtggtctttgtgagctttggcagcctcgcttgcactacacctcaacagcttgttgagctgagactgggacttgaagcctccaggaaaccatttatttgggtgatcgaagcaggagctaagcttccagaagttaaggaatggctcgcagacgagttcgaggagcgtgtcaaaaatagaggcatggtcataaggggttgggcaccacagctcatgatcctgcggcaccaagccgttgggggattcgtgacgcactgcgggaggaactcaacaatagagggcatctgtgcaggtgtgcccatgatcacatggccacactttggggagcagttttggaatgagaagctggtggtggatgtgctgaaaatcggggtggaggttggcgtgaaaggagttacacagtggggaagtgaaaaacaggaggttatggttacaattacaagagatgaggtggagaaagctgtgaacaccctgatgatgaggggggcggctgcagaagagacgaggtgagagcaaaagactgcgccattaaggcaaggaaggcttttgatgagggaggtccttcacatgacaacataaggctattaattcaagaaacgggaaacaagacaaatgcatgtggttgatacagtggtagtaagctctcttttttggtgtgaacataaaataaaagagcatatagtacaaataacctgttgtcattagaaagagcctttatgtcattggaaataattttattttacaaataacccgttccttgtattaggctcactggcgggggcgcgattgttttgagattaaacgagggtccaaatgacagcaatatcaattgtctacgc

SEQ ID NO: 485 - DNA, 1055 bp, Triticum aestivum
tattccccatgacgacttaaattacgcacctccagcaccggggtgctggattttccctgccacaactctcgcacctgatattcaaactcctggccggtcatcaggaaaccgagttgttttgtggtcatctctgcagccggaaaagtcccgaccagctcaccatctttcagcactgaaatacggtcggaaacttcacacacaagtcccaaagcaatttggaagcaccatccatcctagccaggctcccagtagctagcagcttactcaaggaagcagcggcggcaggcggcagcagcgcaacgagtgctcaggacaaggagacatggcgtccatgatgggaggagacttcgtggaggcctacgtgctcaagaacgcctacaaggagaagctgaggcgcatggaccaagccgaagccgcggcggcgctcgacggcgcaaagagcagcaaggacgccgccggggccgctggagagaagaaggaggctggtggtgcgagcagcaggggaggattctttggcctcatgaagaagaaggtgcaccccaaacccaaagcggcggcgggggcggccacttcctcttgattatattgctactgtatttgccatgccacgaaattgtaagccgcagctttcttctagctaggagtgtgtgtgtaggtttgttctttcgatcagcttctcttggaggagtgtgtaaagcaagttcttttgttaattgttcaaaacaagtcgacggaaattaagtcaaggataatccttcattagttgggttgacctccgtttttacttctctgcactatgagatgtttggctatcagtatagacatgtggctgtttggttcctcgttcctttgggctaagcatttcagttcaaacaaaacaaggtcccataaactgcccggctgcattgagctgagttcagccactaaaagaaagttggtgctctccaagagcatctacacccggacatagcgaattcggccccctagacgttggcggatgcgcccggtcagttcccggacatgtccgtttcaagcccctactttataatgatgat

SEQ ID NO: 486 - DNA, 672 bp, Aegilops tauschii
gtctaatcaccccttggactcccgcgcgttcgtccaccagggcctgtctatataaacgaccgggcacgcgcctcaactcgaccctcccacacaactacacaagtcccaaaccatctgcaagcatcattcatcctagctaggctcctaacttacttgtaccttacttattaggcaaggaagcaacggcagcagcaagaataattgaggagaaggaaaggaggagctgataagccatggcgtccatgatgggaggagacttcgtggaggcctacgtgctcaggaatgcctacaaggagaagctcaggcgcatggaccaagccgaagcggcggcggcgctcgacggcgcaaagagcggcaaggacaaggaggccgccggcgccgctggagagaagaagactgctggtggtggtggagcgagcagcaggggaggattctttggcctcatgaagaagaaggtgcaccccaaacccaaggcggcggcgacttccccttgaatactgtatttgcgatgccacgaaattgtaggccgcagctttcttctagctaggagcgtgtgtgtgtgtgtaagtttgttctttcgatcgtttagcttctcttggaggagtgtgtaaagcaaaaccttttgttatttggtaaaaaaaaagttgaaaaaagttacgccaagagtaatcc

SEQ ID NO: 487 - DNA, 365 bp, Aegilops tauschii
cacacaactacacaagtcacaaaccatctgcaagcatcattcatcctagctaggctcctaacttacttgtaccttacttattaggcaaggaagcaacggcagcagcaagaatagttgaggagaaggagaggaggagctgataactgataagagatggcgtccatgatgggaggagacttcgtggaggcctacgtgctcaggaatgcctacaaggagaagctcaggcgcatggaccaagccgaagcggcgctcgacggcgcaaagagcggcaaggacaaggaggccgccggcgccgctggagagaagaagactgccggtggtgctggagcgagcagcaggggaggattctttggcctcatgaagaa

SEQ ID NO: 488 - DNA, 573 bp, Secale cereale
gcttttggaaaagcattatccatccctaggctcccagtagctgcatcagcttacttgagcaaggaagaagaagcggcagcagcagcagcatcatcaggagcagaagaagagttgaggagaggaggagctgagaggaaatggcgtccatgatgggaggagactttgtggaggcctacgtgctcaagaacgcctacaaggagaagctcaggcgcatggaccaagcggccgcgctcgacggcgcaaagagcagcaaggacaaggaggccgccggcgccgctggagagaagaaggcgactgctggtgcgagcagctggggaggattctttggcctcatgaagaagaaggtgcaccccaaaccaaagcagcggctacttcctcttgattatattgatgtagtactgtatttgccataccacgaagttgtaagccgcagctttcttctagctaggattaggagcgcctgtgtatgtttcttctttcgatcagcttctcttggaggagtgtgtaaagcaagttcttttgttaatcggtcaaaaaaaacattttgacaaaaatcaagcaaagcgtaatcct

SEQ ID NO: 489 - DNA, 508 bp, Zea mays
cagctagctgcccagctctcaaagcctcgctcgaatcatcagctagcagcatcgaatcatcagcatggcgtctgccggccgccgtcccacggtgctcaagcagatcgctctcttcctcgtcgtcgcggcggtgatcatgaacagctccgtctgccttggagccgctggccacgacgccactgtagtaggcactggtagcaacgaccctaaccaccctgcttttccgtcgccgcctggtaaaccctacaccggtcgtccgtgcagcaaaatttacggctgtaatgtaccaccggcaggtggccagccctaattacacccgtgcgcaggcctcatcttccaaaacaatgcaaggatcgatcggtttatgtaacggaacggcggcctagacgcatatactatatgcggcatcaatgcatgcctcctatgtaatgtatgtaacgtatcatcacaagttactctaccgccatgcacgaccttatacagtgataccatctcgtgtatatactag

SEQ ID NO: 490 - DNA, 1875 bp, Sorghum bicolor
gtcgtgcccgcgggtcaaaccccaagacgagcccgtataaaacggcacccgcgcgcaggcggcagctagcctctccaatcgaccggggaagtcacgcgcgttcgggtcagtgagaaaaatcgccccgcagcccgcatttccccagccagcaggcagcagccttggtgagacctcgcgttgtaccgtacgtacgtgacatcgccggaaaccagcgtgccgcccaggacgatggcgccgcgccagccgctgctccccagcttcctctacgcggcgtcgtcgcccggcggcagggatgcgcggcctccggtggtggtggcgagggcgccgagcgagccgccgttcggcaagatcgagatgttctcgcccgcctactacgcggcgggcgccatcggcggggccgcggcctgcgggttcacgcacgccgccgtcacgccgctcgacgtcatcaagtgcaacatccagatcgaccctgccaagtacaagagcacctcgtcggcgttcggcgtggtgatgagggagcagggcctccggggcttcttcagggggtgggcgccgacgttcgtgggctacagcgcgcagggcgcgttcaagtacggcctctacgagttcttcaagaagaagtacgccgacatggccggacccgagtacgccgccaagtacaagaccgtcatctacctcgcgggatcggccaccgccgaggtcttcgccgacgtcgcgctctgccccatggaggccgtcaaggtccgggtgcagacgcagcctgggttcgccagggggctcagcgatggattccccaagatcgtcagggccgaaggctacgcagggctattcagaggactggttcctctttgggggcgacagattccctacaccatgatgaagttcgcgacatacgagaacatcgtggaggtgacctacaagcacctcatcccgacgccaaaggatgagtgtagcaaacctctccagctcggagtcagcttcgggagcggctacgtcgccggagtcttctgcgccgccgtttcgcaccctgcagacaacttggtttccttcctcaacaactccaagggagccaccgttggagatgctgtcaagaaccttggcttgttgggccttttcacccgcggccttcctcttcgcattctgatggtcggtaccctgactggagctcagtgggtgatctatgattccttcaaagttatgattggactgccaacgactggtggagcgcctgctcctactactgtcccactggaaggactgggagagctaaaagcctcagcctgaagttctaaactttggcagagaatatacttcttccgtccatagcgtatccatagcgtatattggtgactgcaacagcacctcaaccccacctccgatcccaccacaaaggattgtttcaagctggtgaattttttgaataaaatgagttattactgtatgttctgaatacagaatacgacaggcagaagactagaagttactagacataaaagttggatgtaatttttgggttcgtactgaattggctctcctagacgttcatttgattgattgcactaaattgtacatgtgctctaatgtgaatgtattcatattgcgcacacaccataccatgtactcgatggtttgtctctgtggaatgatgctgattaaacaaactaagtaacaaaccaaacagacatgcatgccagcagctaattacagttagttccactcacatttattttgatcaagttgtgtagtagacccccaagatactttatgatatttaaattaattgtaatgtgaatcatgtaatcttagttgagaatccatgtccacttcctcaaagcgaacaattctcggtgcacaggatgcattctcttggtgttc

SEQ ID NO: 491 - DNA, 1836 bp, Setaria italica
ggaaaaccacgagccatccgtgaaatcgccgcgccagagcctgcccgagctccgcccacgcacgcttccaagcttccaacgcggcgcgggcacgtgacgtgacacatcgtccccgagatggcgccgcgccagcagcagccgctgctcccgagcttcctctacgcgccgcggcccggcgccagcggccgccgggaggcgccgcccgccgcggtggtggcgggggcgccgagcgagccgtttgggaagatcgagatgttctcgccggcatactacgcggcgggcgccgtcggtggggccgcggcctgcgggttcacgcacgccgccgtgacgccgctcgacgtcatcaagtgcaacatccagatcgaccctgccaagtacaagagcacctcgtcggcgttcggcgtggtgatgagggagcagggcctccgcggcttcttcaggggctgggcgccgacgttcctggggtacagcgcgcagggcgcgttcaagtacggcctctacgagatcttcaagaaggagtacaccgacctcgccggccccgagtacgccgacaagtacaagaccctcatctacctcgccggctcggccaccgccgaggtgttcgccgacatcgcgctctgccccatggaggccgtcaaggtcagggtgcagacgcagcccggctacgccagggggctccgcgacggcttccccaagatcgtcaggtccgagggatatgcagggctgtttagaggactggttcctctttgggggcgacagattccttacaccatgatgaagttcgcgacatacgagaacatcgtggagatgacctacaagcacctcatctcaacgccaaaggatcagtgcagcaaaccactccagctcggagtcagtttcgggagcggctacatcgccggagtcttctgcgccgccgtctcgcaccctgccgacaacttggtctcgttcctgaacaactccaggggagccactgtcggagatgctgtcaagaaccttggcctcatgggccttttcacgcgtggccttcctcttcgcattctgatggtcggtaccctgactggcgctcagtgggtcatctatgattccttcaaagttatgattggactgccaacgacaggtggagcgcctgctcctaccactgtcccactggaagggctggcagagctgaaagcctctgcttgaaggtccaaaactttgacagataatgtaattctttcatcgttactacgtgggtgtttgggagacaagggctaaactttaaccctgtcacatcggattcggatactaattatgataactaaatatgagctaattacaaaactaatagcagaacccctaggctaaatcgcgagacgaatctattaagcctaattaatccatcattagcgaatggttactgtagcaccacattgtcaaatcatgaactaattaggcttaatacgtctcatgatttaacctaggggttgtgtaattagttttgtaattagtctaagtttaatactcctaattagtgtccaaacattcgatgtgacgggggctaaaatttagccccctcctcccaaactccgcctatattggtgattgtaacaattttccgcccggagggttgtcccaggcttgcgaaattttttaataaattagttactgctacctgttatgaacagaatacgaaagatgaagttactagtcataaagttgataaaaatatttggatgcaaattatttgggtttgtactaaactgaccctcctttggtcaattgatggcactaattgggtgccctaatgtaaatgactaaatgtattcatatcggataataccatgtttcatgttgcag

SEQ ID NO: 492 - DNA, 2082 bp, Panicum virgatum
cggatagaacagattttttttaaaaaaggaatagaacattgagacgtgcagcttcgaaatagctggacagagtccaatatgccgggggtttctacctttagcttgcagaccatcataacatagatggttcgaaggtattttgggtcgctttgcaacgagaagaatcaaaggcacacgtgacaaaagacaaaacaaacctggcattaggaataggtattaccggattctattttccgtctcaaactaaagtattgtagagagtttacaacttgaaacatgcaaccaagtgcgcacccggccagtggagtaggtacatgtggccagttccaggaaagaacccagcatttcgcgaaaggggaaaaaaaccggagagagagagagagaggaaagaacccagcaagccgccccatatccccacacgcctcgccaccggcccggccgccttgctttccaagccgtcgtgcgggtcaaaccccaagacgcacgtcgcgtcgtcgcgcaccgagctcttccccgtataaatggcagctgcgcgcgcgcaggcaggcgcccgctccaactgcccgggagagacagagacccacgacgagtcatccgtgaaatcgcggcctcgagctccgcccaagccgcctccaacaacaccatccctcacggtcatggcgccgcgccagcagcagcagcagccgctgctcccgagcttcctctacgcgccgccgcccggcgcgaccggcggcagggaggctccgcccgcgccggcggtggtggcgggggcgcccagcgagcctccgttcgggaagatcgagatgttctcgccggcctactacgcggcgggcgccctcggcggggccgcggcctgcgggttcacgcacgccgccgtgacgccgctcgacgtcatcaagtgcaacatccagatcgacccggccaagtacaagagcacctcgtcggcgttcggcgtggtgatgagggagcagggcctccgcggcttcttcaggggatgggcgcccacgttcctggggtacagcgcgcagggcgcgttcaagtacggcctctacgagctcttcaagaagaagtactcggacctcgccggcccggagtacgccgccaagtacaagaccctcatctacctcgccggctcggccaccgccgaggtgttcgccgacgtcgcgctctgccccatggaggccgtcaaggtcagggtgcagacgcagcccgggtacgccagggggctccgcgacggcttcccgaagatcgtcaggtccgaggggtacgcaggcgggctgttcagaggacttgttcctctttgggggcgacagattccatacaccatgatgaagttcgcgacatacgagaacatcgtggagatgacctacaagcacctcatccccacgccgaaggaccagtgcagcgaaccgctccagctcggagtcagcttcgggagcggctacgtcgccggagtcttctgcgccgccgtctcgcaccccgccgacaacttggtctccttcctgaacaacgccaagggagccaccgtcggagacgctgtcaagaacctcggcctcgtgggccttttcacgcgcggccttcctcttcgcattctgatggtcggtaccctgactgcagcccagtggatgatctatgattccttcaaagttatgattggactgccaacgacaggtggagcgcctgctcctactactgtcccaacggaagggctggcagagctgaaagcctctgcttgaaggtccaaaacttcaacaggaaatgtacttctttcattggtaccatattgcattggtgattgtaacaattttcccccacaggattgttattttgaacataatagttactactgtctgttatgagcgcagaacaggaaagttagaagttacaagtcataataaagttgataaatcgtattggatgcaacttgtttgggctgcacttaactagccctcgtatggtcatttgatggcactaaatttgtgctctaatgtaaatgtactcatatagaattatgtgaaatatatcatattgtaagttgtaacatggccccgatcaaatatcaaattttcattttggaaaagg

SEQ ID NO: 493 - DNA, 2232 bp, Panicum virgatum
agaagaaaccggagccctaacaaatagatcgaattataccatgacgtagtgaattcctcagcatagtttggacttttcatgtgaacatccgttgatagctaggtcagtcgagttgagcccagccgcctcacttctacgtggcccaaccaattgggttgaccttgtacatcagaacatgacgatcgggctgaccgaatagaacagatatttagacgtgcatcttcaaagtagctagacagagtccaatatgccgggtgtttctacctttagcttggagaccattataaacatagatggttcgccggtattttgggtcgctttgcaacgagaagaatcaaaggcacacgtgacaaaagccaaaacaaacctcgcattcaggaacaggtactattagttaccagattctagaatctaaatcgttgtttcccgtttcaaacaaaaggattgttgagagtttacaacttgaaaaaacatgcaaccaagtgcgcacccagtggagcaggtacatgcggcctgttccaggaaagaacccagcatttcgctaaacaaagaaaagaaacaaaaaggaaagaacccagcaagctgccccagttccacacgcctcgccgccggccggccggccgccttgccttccaagccgtcgcgcgggtcaaacctcaggacgcaacgtcgcgcgagcttccccatataaaatggcagctgggcgcgcaggcagccggccgctccaaccgcccgggagagacccacgaggccacgagccatccgtgaaatcgccgcgcctgcctcgagctccgcccaagcctcctccaacgccgacgtgacgcgacagcatcgctcatggccatggcgccgtgccagcagcagcagcagccgctgctcccgagcttcctctacgcgccgccgccgtccggcgcgaccggcggcagggaggcgccgcccgcgccggcggtggtggcgggggcgccgagcgagcctcccttcgggaagatcgagatgttctcgccggcctactacacggcgtgcgccgtcagcggggccgcagcctgcgggttcacgcacaccgccgtgacgccgctcgacgtcatcaagtgcaacatccagatcgaccctgccaagtacaagagcacctcgtccgcgttcggcgtggtgatgagggagcagggcctccggggcttcttcaggggctgggcgcccacgctcctggggtacagcgcgcagggcgcgttcaagtacggcatctacgaggtcttgaagaagaagtactccgacctcgccggcccggagtacgccgccaagtacaagaccctcatctacctcgccggctcggccaccgccgaggtgttcgccgacgtcgcgctctgccccatggaggccgtcaaggtcagggtgcagacgcagcccgggtacgccagggggctccgcgacggcttccccaagatcgtcaggtccgagggatatgcagggctgttcagaggacttgttcctctttgggggcgacagattccttacaccatgatgaagttcgcgacatacgagaacatcgtggagatgacctacaagcacctcatccccacgccgaaggaccagtgcagcaaaccgctccagctcggagtcagcttcgggagcggctacgtcgccggagtcttctgcgccgccgtctcgcaccccgccgacaacttggtctccttcctgaacaactccaagggagccactgtcggagatgctgtcaagaaccttggcctagtggggcttttcacgcgcggccttcctcttcgcattctgatggtcggtaccctgacaggagcccagtgggtgatctatgattccttcaaagttatgattggactgccaacgacaggtggagcgcctgctccaactactgtcccaatggaagggctggcagagctgaaagcctctgcttaaaggtccaaaacttcaacagaaaatgtacttctttcatcggtaccatattgcattggtgactataaagatttccccccaaaggattgtaattttgaacaaaatagttactactgtctgttatgaggtcagaataggaaagatagaagttacaagtcataataaagttgataaatcgtattggatgcaacttgtttgggctgtacttaattggccctcgtatggtcatttgatggcactaaagtttgtgctctaatgtaaatgtactcgtatagaattatgtataatatatcatattgtaacatgaccccg

SEQ ID NO: 494 - DNA, 1358 bp, Oryza sativa
cgaacgaacaccacaaggtgtccacaacacaaagccgcccggcccgagacgacgcggcgatcaaagtcatccaaccaccacgaaaccacaggggccagcgtcgtggcgacagagatggcgccgcgcaactcgctgctcccgagcttcctctacgacggggtcggcggcggcggcgggggcgcgccggcggtcgtcgcgggggcgccgagcgagccgccgttcgggatgatcgagctgttctcgccggcatactactccgcctgcgccttcggcggggccgccgcgtgcgggctcacccacgccgccgtgaccccgctcgacgtcatcaaatgcaacatacagatcgacccgaccaagtacaagagcacgacgtcggcgttcggcgtcgtgatgcgggagcagggcgcgcgcggcttctacagggggtgggcgccgacgttcctcggctacagcgcgcagggggcgttcaagtacggcctgtacgaggtgttcaagaaggagtacgccgacatggccgggccggagtacgccgccaggtacaagaccctcatctacctcgccggctcggccaccgccgaggtggccgccgacgtcgcgctctgccccatggaggccgtcaaggtccgcgtgcagacgcagcccggctacgccagggggctcagcgacggcttcccaaagatcgtcaggaacgaaagctatgcaggtctgttcagaggcttggttccgctttgggggcgtcagattccttatactatgatgaaatttgcgacgtacgagaacatcgtggagatggcatacaagcatctcatccccacaccgaaggagcaatgcagcaagcctctgcagcttggagtcagcttcgggagtggctacattgctggagtcttctgcgccgccgtctcgcaccctgctgacaacttggtctcgtttctcaacaactccaagggcgccaccgttggagatgctgtcaagaaccttggcctctggggccttttcacccgcggccttcctcttcgcatcctcatgatcggtacactgactggaactcagtgggtgatctatgattctttcaaagttatggttggcctgccaacaactggtggtgctcctgctcctgctgctatcccaatcggagaactggcagagctgaaagcctctgcttgatcttattgtaacattttgtatccatatttcattatcaaaatacggattagtagctgggtgatattgttttctctccatacaaattgtaacctttgggtgatattgtttttttttcattgtcccatgcaaatagtgcaccaccataatgtagacgttattaattagtacttggtgaaaagtcaaaaataataaat

SEQ ID NO: 495 - DNA, 1518 bp, Triticum aestivum
caacccactcgcgcgcgcgcttctccgtataaaacggcggccgaccacggccagcccagctgcatcctcgctccaagcggccgggaaaccacggagggctagaagcaacttgccggcgaaaaagcaagcaaactgatcgtgacacttccacccgccggcggggaatcgttcgatggcgtcgcggcagtcgctgctcccgagcttcctctacgcggcgtccagcggcgccggcatgccgggcgggagggccgcgcaagagccgcccgtcgtcgccagggcgccgagcgagccgccgttcgggaagatcgagatgttctcgccggcgtactacgcggcctgcggcttcggcggcgccgccgcgtgcggcctcacgcacgccgccgtgacgccgctcgatgtcatcaagtgcaacatccagatcgacccggccaagtacaagagcatctcctcgtcgttcagcatcgtgctcaaggagcagggcgtccgcggcttcttccggggctgggcgcccacgttcctggggtacagcgcgcagggcgcgttcaagtacggcctgtacgaggtgttcaagaaggagtacaccgacatggccggcccggagtacgccgccaagtacaagaccctcatctacctcgccggctcggccaccgccgaggtcgtcgccgacgtcgcgctctgccccatggaggccgtcaaggtgcgggtgcagacgcagcccggctacgccaggggcctgcgcgacggcttccccaagatcgtcagggccgaaggctatgcagggctgttcagaggaatggttcctctttgggggcgacagattccttacaccatgatgaagttcgcaacctacgagaacatcgtggagatggcgtacaagcacctcatccccacccccaaggagcagtgcagcaagcctctgcagctcggggtgagcttcgggagcggctacatcgccggagtcttctgcgccgccatctcgcaccccgccgacaacctggtctccttcctcaacaatgccaagggcgccaccgtcggagacgctgtcaagaacctcggcctctggggactcttcacgcggggccttccgctccgcatcgtcatgatcggcacactgaccggcacccagtgggtgatctatgattccttcaaagtcatggctggactgccaacaaccggtggaactcctgctgctgccccaagggaagaagcgtgagcagtgaaagcctttccggaacttcaagagaaaaatatgtttttattgttgacatcgcataatctgtagtagattgatgattgtaacagttttcctcagcactgtgccaccatttaccgattgatgaaatttgtcattagattggtcattaaggttccaaacaatagttacttagcgagaagagtggttcacagtcacactcgatggaaccattcaaagtttgtacccatcaaaacagtctttcgtcccgctttataataaaataatcatcatgtccatacggcaagtttaaggcaagccagtac

SEQ ID NO: 496 - DNA, 1313 bp, Aegilops tauschii
cgggaaaccacggagggctagaagcaacttgccagcgaaaaagcaagcaggctgatcgtgacacttccacccgccggcgggggaatcgttcgatggcgtcgcggcagtcgctgctcccgagcttcctctacgcggcgtccagcggcgccgccatgccggacgggaggggcgcgcccgtcgtcgccagggcgccgagcgagccgccgttcgggaagatcgacatgttctcgccggcgtactacgcggcctgcggcttcggcggcgccgccgcgtgcgggctcacgcacgccgccgtgacgccgctcgatgtcatcaagtgcaacatccagatcgacccggccaagtacaagagcatctcctcgtcgttcagcatcgtgctcaaggagcagggcgtccgaggcttcttccggggctgggcgcccacgttcctggggtacagcgcgcagggcgcgttcaagtacggcctgtacgaggtgttcaagaaggagtacaccgacatggccggcccggagtacgccgccaagtacaagaccctcatctacctcgccggctcggccaccgccgaggtcgtcgccgacgtcgcgctctgccccatggaggccgtcaaggtgcgggtgcagacgcagcccggctacgccaggggcctgcgcgacggattccccaagatcgtcagggccgaaggctatgcagggctgttcagaggaatggttcctctttgggggcgacagattccttacaccatgatgaagttcgcaacctacgagaacatcgtggagatggcgtacaggcacctcatccccacccccaaggagcagtgcagcaagcctctgcagctcggggtgagcttcgggagcggctacatcgccggagtcttctgcgccgccatctcgcaccccgccgacaacctggtctccttcctcaacaatgccaagggcgccaccgtcggagacgctgtcaagaacctcggcctctggggactcttcacgcggggccttccgctccgcatcgtcatgatcggcacactgaccggcacccagtgggtgatctatgattccttcaaagtcatggctggactgccaacaaccggtggggctcctgctgctgccccaagggaagaagcctaagcagtgaaagcctttccgaaattccaagagaaaaaaaatatgtttttattgttgacatcgcatgatctgtaatagattgatgattgtaacagttttcctcagcactgtgccaccatttaccgattgatgaaatttatcattaggttggttattaaagttcttctcacccaaacaatagttacttagcga

SEQ ID NO: 497 - DNA, 1457 bp, Secale cereale
accaccttgcttcccaagccgccgaacggtcaaaagatgcatgagcacgacgggcaacccactcgcgcgcgcttctccgtataaaatggcggccgaccacggccatccatcctctcgctccaagcggccgggaaggcacggagagctagcaccagcagcagcaacttgccggcgaaaaagcaagcaaaactgatcgcgacacttccacccgccggcgggggaatccttggatggcgtcgcggcagtcgctgctcccgagcttcctctacgcggcgtccagcggcgccgccatgccgggcgggaggggcgcgcaagaggcgcccgtcgtcgccagggcgccgagcgagccgccgttcgggaagatcgacatgttctcgccggcgtactacgcggcctgcggcttcggcggcgccgccgcgtgcggcctcacgcacgccgccgtgacgccgctcgatgtcatcaagtgcaacatccagatcgacccggccaagtacaagagcatctcctcgtcgttcagcatcgtgctcaaggagcagggcgtccgcgggttcttccggggctgggcgccgacgttcctggggtacagcgcgcagggcgcgttcaagtatggcctgtacgaggtgttcaagaaggagtacaccgacttggccggcccggagtacgccgccaagtacaagacactcatctacctcgccggctcggccaccgccgaggtcgtcgccgacgtcgcgctctgccccatggaggccgtcaaggtgcgggtgcagacgcagcccggctacgccagggggctgcgtgacgggttccccaagatcgtcagagccgaaggctatgcagggctgttcagaggaatggttcctctttggggtcgacagattccttacaccatgatgaagttcgcaacctacgagaacatcgtggagatggcgtacaagcacctcatccccaccccgaaggagcagtgcagcaagcctttgcagctcggggtgagcttcggcagcggctacatcgccggcgtcttctgcgccgccatctcgcaccccgccgacaacctggtctccttcctcaacaatgccaggggcgccaccgtcggagacgctgtcaagaaccttggcctctggggcctcttcacgcgcggccttccgctccgcatcgtcatggtcggcacactgaccggcacccagtgggtgatctatgattccttcaaagtcatggctggactgccaacaaccggtggagctcctgctgctgccccaagggaagaagcgtgagcagcgaaagcctttccgaaactccaagagaaaatatgtttttattgtccacatcgcataatctgtagtagattgatgattgtaaaagtcttcctcagcactctgccagcatttaccgattgatgaaatttgtcattagctaccaaaaaaaaaaaactaagagaccccgacgacgcacaggaggac

SEQ ID NO: 498 - DNA, 1618 bp, Lolium multiflorum
gaaccactctctggcgcttgattctcagtataaaatggcggccgcgcgcgggcaggtcggctgcagcctccaagcgaccaggaagccacagagctagcagccaccgagctacctgaaaagcaattcaagaactgatcgtgacagacatctcagtttctgcccgccggcgagggaggggaaccggtcgatggcgcgccagtcgctgctcccgagcttcctctactcgccgtccaggtcaggcggcgccggcatgccggacgggaggggcgccagcggcgtcgtcgcggggtcgccgagcgagccgccgttcgggaagatcgagatgttctcgccggcgtactacgcggcctgcggcgtcggtggcgccgccgcgtgcgggctcacgcacgccgccgtcacgccgctggatgtcatcaagtgcaacattcagatcgacccggccaagtacaagagcatctcgtcggcgttcggcatcgtgctgaaggagcaggggttccgcggcttctaccgtggctgggcgccgaccttcctggggtacagcgcccagggcgcgttcaagtacggcctgtacgaggtgttcaagaagcagtacagcgacatggccggccctgagtacgccgcccagtacaagaccctcatctacctcgccggctccgcctccgccgaggtcatcgccgacgtcgcgctctgcccgatggaggccgtcaaggtgagggtgcagacgcagcccggctacgccagggggctgcgcgacgggttccccaagatcgtcaggtccgaaggctatgcagggctgtttagaggaatggttcccctttgggggcgacagattccatacaccatgatgaagttcgcgacttacgagaacatcgtggagatggcgtacaagcacctcatccccaccccaaaggaccagaccagcaagccggttcagctcggcgtgagcttcgggagcggctatgtcgctggagtcttctgcgctgccatctcgcacccagcggacaacctggtctcctttctcaacaacgccaagggcgccaccgttgcagatgctgtcaagaaccttggcgtatggggcctcttcacgcgcggtcttccccttcgcatcctcatgatcggtacactcactggtactcagtgggtgatctatgatgcattcaaagtcatggctggattcccaacaaccggcggagctcctgctgccgtgcgaaaggaagaactgacagaagggcaagcctctgcttaatcttctggaacttcgagagaaaatatgcttctaccatccagattgcaacgtacagtagtagtatattggtggttgtaacattttttgcctcacagtttgtcaccactaactggttggcgaaatttttcattaggtttgttattatggttcttctcctgcaaataaccaccaacaggtcgaagttataagttacttggccaaaagagtggatcatacattcatactcaatggatcgttcaaatttgtacctacttgatgttcttttttgtggccatttgctcatgaaacgtagttgtcatgtactccctgtattgtctttcaatgaaaattgggcgatcgatatagccctcttagactgaaattgtgcgcgaa

SEQ ID NO: 499 - DNA, 1384 bp, Sorghum bicolor
cacgaggtcggcccccgcgttcacgagagaagggaggcaaggcaaccaccgcagcagctgcgacctgcgagtgctagcgaggaggcagcgcaccacgtcctgggcgggcggaggagttggagccggcggcgcggagatttgtgcttgcccggcttggggttgggggtgtgagagagacaaccggcgatggcggcgtccgcgaggccaggggagagagcgaccagcttcaccgtcgcgtgcagcctcctcagccgcttcgtccgccagaacggcgccgcggctgccgagctaggcctcgggatcaaaggcgaggtcgagcagcagaggacgccggcgacaattagcttgctccccggagcggagggcgaggaggccgagaggacgaaggagaccatggagctgttcccgcagagcgccgggttcggcgtcaaggatgctgctgcccctagcgagcaagaaaataaagagaagcctaagcagctcaccatcttctatggcgggaaggtgctggtgtttgacgatttccctgccgacaaggcaaaggacctgatgcagctggccagcaagggcagccttgtggtacagaacgttgttttgcctcaaccttctgcacctgctgctgtcaccgacaaggccgtgccggccccggtcatcagcttgtctgctgctcaggctgatgctaagaagcctgctcgcacaaatgcttctgatatgcctattatgaggaaggcgtctcttcaccgcttccttgagaagagaaaggatcgtctcaatgcaaagacaccatatcagacttctccttcagatgcggcgccagtcaagaaggagcccgagagccaggcatggcttggattaggaccgaatgccgtgaagtccaacctgagcctgagctagtacacaacaacaacacagccaaataagacggcacagcaacctcaccaagcccttctgcagaatgatctgaaatttgctttgccactagaccgagtaccaaaatcataaatatctctcgttgtcgtgttttagtatttcgtttaggtcgtggttttacgccctcttgtcacatagttctggatgtaaagaaaagtagccagccagtcatgaccatcaccgttgagtccgagagcagtttttgtgggggtgttttaacacacggcagactctgaattggccatgctaagtaaaatgatagcgcaaagagaagtatatgtattattttctgaaagccagatccatttggctctagccttgatgtattcagaacaagtgattgtaacggatcgtgagtatcctcatcttgttattgttgttgttttctgatcacatggcttcaccaacccaagtttgtttggatccttgttattcctgctgcttcaaatctctg

SEQ ID NO: 500 - DNA, 1227 bp, Zea mays
gagaagaagggagaggagaggctaaccaccgcggcagctgcgacctgcgaccgcgaggagtggcgcacgacgaccagcgcggaggaggtggagccggcggcggggagatttgctcgcccggctggggttgcggtgggaggagggtaggaggcagagacaaccagcgatggcggcgtccgcgaggcccggggagagggcgaccagcttcgccgtcgcgtgcagcctcctcagccgcttcgtccgccagaacggcgccgcgcccgcccagctaggcctcgggatcaaaggcgaggtcgagcagcaaaggacgccggcgacaattaacttgctccccggagcggacggcgaggagaccgagaggaggaaggagaccatggagcttttcccgcagagcgccgggttcggtgtcaaggatgccgctgctgcccctagagagcaagaaaataaagagaagcctaaacagctcacaatcttctatggcgggaaggtgctggtgtttgacgatttccctgccgacaaggcaaaggacctgatgcagctggccagcaagggcagccctgtggtacagaacgttgttttgcctcaaccctctgcacctgctgctgctgtcaccgacaaggccgtgccggtccccgtcatcagcttgcctgctgctcaggctgatgctaagaagcctactcgcacaaatgcctctgatatgccaattatgaggaaggcttctcttcaccgcttccttgagaagagaaaggaccgtctcaatgcaaatgcaccataccaaacttctccttcagacgctgcaccagtcaagaaggagcccgagagccaggcatggctcggattaggaccgaatgccgtcaagtccaacctgaacctgagctagcacacaacgacacagccaaataagacggcacagcaaacctcaccaaagcctttgcaggacgatctgaaaatatgctttgccactagagtaccgaaaccataaatatcctctcgttatcgtgttttagtgttctgtttaggccgtggtcctacgccctcttgtcacatagttctggatgtaaagataagtagccagccatgaccgagagaaggttttttttggggggtgttaacacacggccactctgaattggccatgctaaggaaaatgatagtagtgcaaagagaagtatatgtctttttctttttctgaaagcccagatcgtttggctctagccttgatgtatg

SEQ ID NO: 501 - DNA, 1322 bp, Saccharum officinarum
tccgtggtgtcgacctacgcgtacgcgctcacgagccatagagagaagggaggctaaccaccgcagcagctgcgacctgcgagtgcgaggagtagcgcaccaccgtcgtgggcggaggagttggagccggcggcgcggagatttgcttgcccggctggggctggaggtgagacaaccggcgatggcggcgtccgcgagaccaggggagagagcgaccagcttcgccgtcgcgtgcagcctcctcagccgcttcgtccgccagaacggcgccgcggccgccgagctaggcctcgggatcaaaggtgaggttgagccgcagaggacgccggcgacaattagcttgctccccggagcgaagggcgaggaggccgagaggaggaaggagaccatggagctgttcccgcagagcgccgggttcggcgtcaaggatggtgctgctcctagggagcaagaaaataaagagaagcctaagcagctcacaatcttctatggcgggaaggtgctggtgtttgatgatttccctgccgacaaggcaaaggacctgatgcaggttgccagcaagggcagccctgtggtacagaacgttgttttgcctcaacctcctgcacctgctgttgtcaccgacaaggccgtgccggccccagtcatcagcttgtctgctgctcaggctgatgctaagaagcctgctcgcacaaatgcttctgatatgcccattatgaggaaggcctctcttcaccgcttccttgagaagagaaaggatcgtctcaatgcaaagacaccatatcaaacttcttcagatgcagcaccagtcaagaaggagcctgagagccaggcatggcttggattaggaccgaatgccgtgaagtccaacctgagcctgagttagtacacaacaacacagccaaataagacggcacagcaacctcaccgagcctttgcagaatgatatgagatttgctttgccactagatcgagtaccgaaaccataaatattctctcgttatcgtgttttagtgttttgtttaggttgtggttctacgccctcttgtcacatagttctggatgtaaagaaaagtaggcagccagtcatggccatcaccgggagtccgagagaagtttttggggggtgtttaacacacggcgactctgaattggccatgctaaggaaaatgatagtgcaaagagaagtatatgtattttctaaaagccagatcgtttggctctagccttgatgtatgcagaacaagtgattaatggatcctgagtatcctcattgtattgttgttttctgatcacatggcttcgcaaacccaggttggttt

SEQ ID NO: 502 - DNA, 2608 bp, Panicum virgatum
cgtgccctcctctgctctcgcaagaacaggggcgcgagcgcggccgccggtttgacccgcccgcgaggttataagaggcggtctccacggtaacgggcctctcgcgcaagctgctcacgttttcccgcgccggctgcctgctcggtctcggattccctcagccgagagcgagaggaggagaggagaggaccggccggcgggcgcgcgtgcggggcgcttctttccctgcccgtctctttctctcgtctcgcgctctccgtccgcgaagattagtcgcttcgtctcttgattccggcggcggaggcgtggttggcccgttcgtctttggcggcggcggcgcggggccgtagatgtgagggaggcacccccccggcagcagagcgtccgtcggcggcgatcgatggagtcggtgaaggcgtgggtggcggccaactacgcggagcccatgacgtcgatgcagcagtcgctgcgcgtcgcctacgtggtcttctccttctgcgccgccttcttcctcggcggcatcaaagcgatggtggtcggccccgtggcggcggcgctgatgatcctgggcaacgtcggcgtcatactcgtgctcttcccggcgcacgtctggtggacaatctactcgctcgtcaagactgaccgaatcaactcgggcctgaaactggccgtgctcctcgcgctgccggtcctgttcggcctctggctggggctcggcatcttcggcagcgcgctggtggcgctcggctacggcttcttcacgccctggatctccaccttcgaggcgttccggcaggagagcgaggctaagaagttcgtgcacggcattgtggacgggacgtggggcacgatcaagggcagctgcacggtggttagggacttcgcggacatgtgcttccactcctacccggtctacctcaaggagctgcgcgagagctcccaggatcgcgagccccattcgataaggttgctggatgtgccttcatgtatagttgttgctctcttggggttggtcgtggacataccgctctacacggtgatcgcgctgatcaagagcccctacatgctcttcaaaggctggcagaggctgctgcacgacctcatcagccgcgaaggcccgttccttgagacagtgtgcgtgccgatcgctggcctggctatccttttctggccactggcggtggttgggagcatcctgttggctattgtctcgagcattttcgtgggcctctacggcgcagtcattgtcttccaggagaaatcgtttcagaggggagtttcatatgtcgtagccatggttgcagagttcgatgagtacaccaatgattggctttacctccgcgaaggaacaattctcccaaagccttcctacagaaagaggaaatcatccaactccacagagttctcagtcagaacaaatgcctctgtcaaaggagctgaacatccttctggttccagtgcagcaccagcaatgttggttccgaatttggctcctgcaagatcagtaagagaggctatacaagaagttaaaatggtccagatctgggagaacacgatgaaggcgtgcgagcagagaggcagggaccttctgaacctgaatgtcataacggccgtcggcctgagcgagtggctgaggggaaaggaaagcggccacgagaccataagcctgggcctgccttcctactccctgctgtgcagcgtgctgcagtcgatcaaggccggcgccgggggcctgctgatgggcagcgtcgaggtgaaccagttcaacaggccccaggaccggctgctggactggttcttccaccccgtgctggtgctcaaggagcagatacaggtgctgagcatgacggaggaggaggtgaggttcctggagaagctgaccctcttcgtcggcaacgccgcgggcggtagcgcgtgggacaacggcgacgaggtgccccaggatcccgtcaggctggcgcagattcaggccatcagcagaaggctggtcgggatcgtgaggagcctgtccaagttcccgacgtacaggagaaggtacaggcacgtcgtgaagctgctcatcgcgtactccatcgagcgggatggctcgtgctggtcgtcggcgtcgaaccactcggtttcgttattcgaaataacacagctcgacgtgtaaatttaatttcggagcgatcccgaactgtaattaaagccatcttaggatcaggtaactccagtttttttttcgttctttttttttccttcagtaaatatcgcacgccgttttgccagtgcctgccatttgtgtgtctcaagcctagtagggaggtttcaggtttctgtacaagtgtcgactagtagtcgttacaggagataggcgccatttgcagatgctgatcagaggcgttcgcgtgccgaaacttcaggcacaagtcagcagctgcaccgcacacttggtacattttcttttgtgtgtagcttgtcttttttttccccgaaagattgtgtatagcttgtcaatccaatgcacatgtgttgtccctcttagggcgtctgtaatgactagttatttggctagctagatctgatgtggcaataaaaaaagtaagagagagtagtcactagcgacgag

SEQ ID NO: 503 - DNA, 1978 bp, Brachypodium distachyon
atcacctcagcgctcgcttgaacccacacgacacagcacttccatccaacctgcagaggaggcagcatggcagccttggcgatcagggcggccttcgctgcggtcgccacctccttagccgtctactggctcctcaattcgtcattcctgcagacgccgaacatcgcgctgagcctgccggcagcagcagccgccttcgtcgtcgtcgccatcgcggcgagcgggcccggtcaccgcagtgacggcacgccgcccgggccggcggccctgcctgtgttgggcaactggctgcaggtgggcaacgacctgaaccaccggttcctggcccgtctctcggcgcgctacggccccgtgttccggctccggctcggtgtgcgcaacctggtggtggtgtccgacccgcggctggccacggaggtgctccacacgcagggcgtggagttcggttccaggccccgcaacgtggtgttcgacatcttcacggccaacggcgccgacatggtgtttaccgagtacggcgaccactggcgccgcatgcgccgggtcatgacgctgcccttcttcacggcgcgcgtcgtgcagcagtacagggccatgtgggaggccgagatggatgccgtcgtgtccgacctgcgcgccgaccccgtggcgcgtgtggccggcgtcgtggtgcggcgcaggctgcagctcatgctctacaacatcatgtacgggatgatgttcgacgcgcggtttgagtccgtggacgacccattgttcgtgcaggccacacggttcaactccgagcgcagccgcctcgcgcagagcttcgactacaactacggcgacttcatccccatcctcaggcctttcctgcgtggctacctcaacaaatgcagggacctgcagagcaggagactcgccttcttcaacaacaactacgtagagaaaagaaggaaggtgatggatagtccaggagacaaggacaagctccgatgcgcgatcgaccacatcctcgcagccgagaagaacggcgagatcacggcggagaacgtgatctacatcgtcgagaacatcaacgtggcggccatcgagacgacgctgtggtccatcgagtgggcgctggccgaggtcgtgaaccacccggccgtgcaaaccaaagtccggggcgagatcaaggacgtgctcggggacgacgagcccatcaccgagtccaacatccaacagctcccttacctgcaggccgtgatcaaggagacgctgcggctgcactccccgatcccgctgctcgtcccgcacatgaacctggaggaggccaagctgggcgggtacaccatccccaggggctccaaggtggtcgtcaacgcctggtggctggccaacaacccggagctgtgggagaagccggaggagttcaggcccgagaggttcttggacgaggacagcggcgtggacgcggccaccatcgggggtaaggcggacttcaggttcctgccgtttggcgtgggccgtcgcagctgccccggcatcatcctggccatgcccatcctcgcgctcatcgtcgggaagctcgtgaggagcttccagatgctgcccccgccgggcgtcgacaagctcgacgtcagcgagaaaggtgggcagtttagcctgcacattgccaaccactccgtcgttgccttccaccccatcgactctgcatgaatgtgggattcagagactactccgtacagttaatttcgttttgttttacaggttatacagtaaacaaagtagtactacggtatgttggttggattaaggccagttctattttatcgtttccagctttcagaaatgtatctatgaaatccaaatcattcagactgaaactggaaaacaaacgtgttccttttaaacagccctgtttgatttaagaattttggttgtttccaaacaaagctggccttaattttgtatcattcagactacaactgaaaacaagaaatcaactgtatggcaa

SEQ ID NO: 504 - DNA, 1691 bp, Panicum virgatum
gccgtcagtcagtcacttgcttcgcttctcatttccatggcctccgacgctgccaacgccgcgattcctcgggtcccgtcccgttcaaggacgtcgacgacggcacggtcccagagcacacacccaaggaggagttcggcgacctcgtggcggcgctgccgcggcggcagcagtccatcctggagctgcgcctgtaccagggcttctggctgccggagcattgggtgccggggcaccatcgtgttccagcgccgcttcgcgccgcgccccgacgacgtggtcctcgccagctaccccaagtgcggcaccacgtggctcaaggcgctggccttcgccgccgcggcgcgcggcgcgcacccgcccgccggcgccgggcacccgctccgccggctcaacccgcacgactgcgtcccgttcgtcgacgagatcttcgcgtccggggaggaggccaagctggacgcgctcccgtcgccgcggctcatgaacacgcacctgccctacacgctgctgccggccccggtcaccggcggcgggtgccgggtcgtgtacgtgtgcagggaccccaaggacatggtggtctcgctgtggcacttcctccggcgcgccaagccggacctctcgttcgacgagacgttcgagtccgtctgcgacggcacggtggcggccggcccggtctgggaccacgtcctctcctactggcgcgcgagggtggcgcgcccggaccgggtgctcttcatcaagtacgaggacctgctgcgggacgccggcgcgaacgtgcggcggctggccgagttcatgggccgtccgttcaccgccgccgaggaggccgccggcgacgtcgaggccgtcgtggacctctgcagcttcgacaagatgaaggggctggaggtgaacaaggctgccagcggcaccgcggggaggtaccgcgccatgccgcgcgacgccttcttccggaagggggtcgccggggactgggcgaaccacatgacgccggagatggcggcgcggctggacgggatcgtccgcgagaagctgcaaggaacaaagctggacttcgcgtgacgatcattttcgagatgctgacctttttggaacgaatctttgcgattctgtcggcatgcacttggtggcactggcacctgcacgaacatgttttggaacttcccgtggccacgttgcgggagaagtttggaactccatgtaatctttttttttaacttcggtcgagcaataatgggagtgtgccaacatatatgtgaattttattaaattattatcttcaataattttgcatcattcgacacctcatgaccttaatgaagttggcaaggtcgcgaggtggtacgagcgcgcgctggtgatggcgtcttcttcaacgcctacttcggttacctcctctccctcccccaagctcgcgcaccggcaccgcgtcgtcggctgcttggagcagcaggaggccatcactcgtacccccgagtgcctcctcaaggacctggaggccggcaagatcgacgacggccccgccccggccgtggccatgggctacgggcgcctccccgccgatgccacgctcaaggacgacgccgtcaccgtcgtgcgcgacgacgaggctcaccagcagcgcgagaccgcgacgtcgaccactttgtgtcggtacgaattagtgcttccagatcttaaggtcaggactt

SEQ ID NO: 505 - DNA, 1950 bp, Sorghum bicolor
aggcaattgggggtcatacaagtagtagacggctataagtctgtccaatcatactagcgttcttcctcgatgattcgtcaggtagtacaatagaaaactgcaactataagccggtccaatcagatttcttgctactccgttttctagctacgctacgccattgcttccaaggtctactcccaagagcgcagctgcgccggcgccggcacgcagccagccatggccatcaaagatgagcagcagccgctgcacatcctcttcttaccgttccttgcaccggggcacctcatcccggtcgccgacatggccgcgctcttcgccgcccgaggcgtcaagtgcaccatcctcaccaccccggtgaacgcccaagtcatccgctcggcggtggaccacgccaacgacgcctcccgcggcaccgagggcgccctggccatcgacatcgccgtcgtgcctttccccgacgtcgggctgccccctggcgtcgagtgcggcccggcccttaattccatggaggaccgcgaaaagttcttccacgcggtgcagttactccgcgatccattcgtccggttcttggcggagaatcgccccgacgccgtggtgagcgacagcttcttcgtctggtccgccgacgccgccgcggagcacggcgtcccgcggatagcgttcctcggcagtagcttgttctcgcgggcctgcaacgacaccacggtgcgcaacaaccccgtggaggccgcccccgacgaccccgacgcgctcgtgctgcttccggggctgccgcaccgcgtcgtgctgaggcgcagccaaatgtttgagcccaagaagcggccggagcactgggcctccatgcagcgcggcaacgccgcggaccagaggagctacggcgaggtgttcaacagcttccacgagctggagccggactacttggagcactacaccacgacgctcgggcgccgcgcgtggctcgtcgggccggtcgcgctcgccagcaaggacgcggcgacgaggggcgccagcaacggtctctcgccggacgcgaacggctgcctgcagtggctcgacaccaagcaggagggctcggtcgtgtacgtgtccttcggcacgctgtcccatttctcgccgcctgagctgcgcgagctcgcacgcggcctcgacatgtccggcaagaacttcgtctgggtcatcggcggcggagcggacaccgaggagtcggaatggatgcccgacgggttcgcagagctgatggcgggcggtgaccgcggcttgatcatccggggctgggcgccgcagatgctgatcctgacccacccggcagtgggcgggttcgtgacgcactgtgggtggaactcgacgctagaggccatgagcgccggcgtgcctatggtgacgtggccgcgcttcgccgaccagttctacaacgaaaagctagtggtggagctgctcaaggtcggtgttggcgtggggtccacggactacgcgtcgaaggtggagacccgtcgcgtgatcggcggcgaggtgatcgcggaggcaatcgtgagagtgatgggcgacggcgaggacgcggtggcaatacgggagaaggccaaggagctcgcggagaaggccaggcgcgcggtggccaggggagggtcctcttacgatgatgtcggacgcttactggacgagctgatggctcgcaggagctccgtcaatgtctgattgagaatacaatactcctctcataatgttcatagtcaaaatggatgatcctttatcacgggacccttcttgtcacatagatagaacgtacatgtacattgtcccttgctcttgcctttgaattttccatttttttaaacttttgttgctctggccttgttcagttgctaaaattttgggatttcgggtactatagcactttcgtttatatttgataaatatcgtcaaattatggactaactaggctcaaaagat

SEQ ID NO: 506 - DNA, 2217 bp, Zea mays
ttcggttatcaaagaaaccgtattccatactaaaatattgtgtgtgtatacacataaagttaatctaggctcatagtatatcatcttttggctaatgtgtttacaaaatatgttttttcatgctcgtcttcatgtcgatcgagctgcatatttgaaaaaaaaaatcatcgacactaaggatgttgaacaaaaatcgagattaaatttatgtatacgagttccagattaatattgtgcacacgaagacgaacatgctgcaatcagactttgacggatctcctacgagccatcagctcgtccactaagcgtccgacatcatcgtaagatgacccaccgttggccaccgcgcgcctggccttctccccgagctccttggccatctcccgtattgcctccgcgtcctcaccgtcgcccatcactctcccgatggccttcgcgatcacctcaccaccaatcacggcgcgccgggtctccagcatggacgcgtagtccgtggatcccacggcgacaccgaccttgagcagctccactaccagcttctcgttgtagaactggtcggcgtaccgcggccacgtcaccataggcacgccggcgctcacggcctccagcgtggagttccacccgcagtgcgtgacgaacccgcccaccgccgggtgggtcaagatgagcatctgcggcgcccagccccggatgataaagccgcggtcgccgcgcgccaccagctccgcgaacccatcgggcatccattccgactcctcggtgtccgcgccgccgacgacccagacgaagttcttgccggacaggtcgaggccgcgcgcgagctcgcgcatctcgggcggcgagaaatgggtcagcgtgccgaaggacacgtacaccaccgagccctctggtttcgcgtccagccactgctggcaggcgcccgcgtccggcgagagcccgttgttggcgcccctcgtcgccacgtccttgctggcgagcgccaccggcccgacgagccatgcgcggcgccccagcgtcgtggtgtagtgctccatgaagtccggctccagctcgtggaagctgttgaacacctcgccgtagctcctctggtccgcagcgttcatgcgctggaagaaggcccagcgctccggctgcttcttgggctccatcatctggctgcgcctcagctcgacgcggcgcggcagccccggaagcagcacgagcgcgtccggtcgtcgggggcggcctccacggggttgttgcgcagcgtagactcgctgcaggcccgcgagaacaagctgctgccgaggaacgctatccgcgggacgccgtgctccgcggcggcgtcggcggaccagtcgaagaagctgtcggtcacggcggcgtccgggcggttctccgccaagaaccggtcgaacggctcgcggagtaactgggccccgtggaagaacttttcgcggtcgtccatggtattaagcgccggggcgcactcgacgccggggggcaggccgacgtcggggaaaggcacgaccgcgatgtcgatggccagggcgccctcggttccgcgggaggcgtcgttggcgcggtctaccgccgagcggatgagttgggcgttcaccggtgtggtgaggatggtgcacctgacgcctcgggcagcgaagagcgcggccatgtcggcgatcgggatgaggtgccccggcgcgaggaacgggaagaagaggatgtgcagcggctgcggctcatctttgatggccatggctggctgcgcgacggcggctgcgcagctgcactcttgcatattttataaggaagggtatagctagaaagcggagtagcaagagatttgaaacttttggcggaagatggtcgtgtatttgtaggatgcatgatgactggagagacttatatttgcagttttctattgtactacctctgcctgatgccttgacagaacagaaccatcgaggaagaatgcaggtagacttgtatgacttggtgatctccatcccagcaagcctccaaggctcaaatggtccagttacttggtgtgtgctccaagtgtgtagcttcattcgcaaattttgaacagcctctgcaagtgcttaattgtacacagtgctttcgtaaacctagagctgaccagctgtgatttcgatgtattccacgaccacgagtgagcaatacgctgcagtgtgctttcgtaaggtatgctccagaagttcagatgagaacgaaagc

SEQ ID NO: 507 - DNA, 2134 bp, Sorghum bicolor
acatgtgttccagatttcttgctactccgcttcctagaaagcgatcgggattagccgctcttgcttccacctgatctagatctactcccgagagagcagctgcgccagcgccggcgccggcacgcagccagccatggccatcaaagatgagcagaagccgctgcacatcctcttcttcccgttcctcgcgccggggcacctcatcccgatcgccgacatggccgcactcttcgccgcccgaggcgtcaagtgcaccatcctcaccacccctgtgaacgcccaagtcatccgctcggcggtggatcacgccaacgacgccttccgcggcactgagggcaccctggccatcgacatcgccgtcgtgccttttcccgacgtcgggctgcctcctggcgtcgagtgcggcccggcccttaattccgtggacgaccacgaaaagttcttccacgccgcccagttactccgcgagccgttcgaccggttcttggcggagaatcgccccgatgccgtcgtggccgacagtttcttcgagtgggcggccgacgccgccgcggagcacggcgtcccgcggatggcgttcctcggcagcagcttgttctcgcggacatgcatcgacagcatgctgcgctacaaccccgtggaggccgcccccgacgaccccgacgcgctcgtgctgcttccagggctgccgcaccgcgtcgagctgaggcgcagccagatgaaggagcccaaggagcagccggaggactgggccttcctccagcgcgtcaacgccgcggacctgaggagctacggcgaggtgttcaacagcttccacgacctggagcgggagtccttggagcactacaccacgacgctagggtgccgcgcgtggctcgtcgggccggtcgcgctcgccagcaagaaccacgcggcgaggggcgccggcgacgagccctcgccggacgcggacagctgccagcagtggctcgacaccaaggcggagggctcggtggtgtacgtgtccttcggcacgctgtcccatttctcgccgcccgagctgcgcgagctcgcaagcggcctggacatgtccggcaagaacttcgtctgggtcatcggcggcggcgcggacaccaaggagtcggaatggatgccccacgggttcgcggagctgatggcgcgcggcgaccgtggcttcatcatccggggctgggcgccgcagaggctgattctggctcacccggcaatgggcggcttcgtgacgcactgcggctggaactcgacgctggaggcggtgagcgccggcgtgcctatggtgacgtggccgcgcttcgccgaccagttctacaacgagaagctggtggtcgagctgctcaaggtcggtgtcagcgtggggtccacggactacgcgtcgaaacttgagacacggcgcctgatcggcggcgaggtgattgcggaggccattgggagagtgatgggcgacggcgaggacgcagaggcaatacgagagaaggccaaggagctcggggagaaggccaggcgtgcggtggccaagggtgggtcctcttacgatgacgtcggacgcttaatggacgagctgatcgctcgtaggagctccgtcaatgtctgatttggaagcatatgggggcgggatttgccagaggccgaacgccatcggaatggggatggaggggatttgccagaggccgaacgccatcggaaaggggatggagagcaggtgtcgtctgccggttgggatctgaggccaaagatgggcgccgtcgagagtatcagagatggacagtagagtagcaaggatagggaagagcggagccaccgggaagagccaccgtgcccacgccattggggaggaggcgtgcgaccggtgggagaaggcgtgcggcgttgggtgcgagtcgagacgcaggcagcggcgtcgggtgcgagtgcgtgcgggaggagaatggagaaaggaaaaaaataggtagccaggtttgttggcccaacagatttaggtagtcaagtaggtagtctgttcgagtgagttttttggcctccactacctagataccggataggtagtgggtttaggtagtgtgctgaaggttttgtctttttttttatttatttggttgaatctttgaaatcatagaga

SEQ ID NO: 508 - DNA, 2316 bp, Zea mays
cgatcagataaacgctttcgttctcatctgaacttctggagcataccttacgaaagcacactgcagcgtattgctcactcgtggtcgtggaatacatcgaaatcacagctggtcagctctaggtttacgaaagcactgtgtacaattaagcacttgcagaggctgttcaaaatttgcgaatgaagctacacacttggagcacacaccaagtaactggaccatttgagccttggaggcttgctgggatggagatcaccaagtcatacaagtctacctgcattcttcctcgatggttctgttctgtcaaggcatcaggcagaggtagtacaatagaaaactgcaaatataagtctctccagtcatcatgcatcctacaaatacacgaccatcttccgccaaaagtttcaaatctcttgctactccgctttctagctacacccttccttataaaatacgcaagagtgcagctgcgcagccgccgtcgcgcagccagccatggccatcaaagatgagccgcagccgctgcacatcctcttcttcccgttcctcgcgccggggcacctcatcccgatcgccgacatggccgcgctcttcgctgcccgaggcgtcaggtgcaccatcctcaccacaccggtgaacgcccaactcatccgctcggcggtagaccgcgccaacgacgcctcccgcggaaccgagggcgccctggccatcgacatcgcggtcgtgcctttccccgacgtcggcctgccccccggcgtcgagtgcgccccggcgcttaacaccatggacgaccgcgaaaagttcttccacggggcccagttactccgcgagccgttcgaccggttcttggcggagaaccgcccggacgccgccgtgaccgacagcttcttcgactggtccgccgacgccgccgcggagcacggccgagtctacgctgcgcaacaaccccgtggaggccgcccccgacgaccggacgcgctcgtgctgcttccggggctgccgcgccgcgtcgagctgaggcgcagccagatgatggagcccaagaagcggccggagcgctgggccttcttccagcgcatgaacgctgcggaccagaggagctacggcgaggtgttcaacagcttccacgagctggagccggacttcatggagcactacaccacgacgctggggcgccgcgcatggctcgtcgggccggtggcgctcgccagcaaggacgtggcgacgaggggcgccaacaacgggctctcgccggacgcgggcgcctgccagcagtggctggacgcgaaaccagagggctcggtggtgtacgtgtccttcggcacgctgacccatttctcgccgcccgagatgcgcgagctcgcgcgcggcctcgacctgtccggcaagaacttcgtctgggtcgtcggcggcgcggacaccgaggagtcggaatggatgcccgatgggttcgcggagctggtggcgcgcggcgaccgcggctttatcatccggggctgggcgccgcagatgctcatcttgacccacccggcggtgggcgggttcgtcacgcactgcgggtggaactccacgctggaggccgtgagcgccggcgtgcctatggtgacgtggccgcggtacgccgaccagttctacaacgagaagctggtagtggagctgctcaaggtcggtgtcgccgtgggatccacggactacgcgtccatgctggagacccggcgcgccgtgatcggtggtgaggtgatcgcgaaggccatcgggagagtgatgggcgacggcgaggacgcggaggcaatacgggagatggccaaggagctcggggagaaggccaggcgcgcggtggccaacggtgggtcatcttacgatgatgtcggacgcttagtggacgagctgatggctcgtaggagatccgtcaaagtctgattgcagcatgttcgtcttcgtgtgcacaatattaatctggaactcgtatacataaatttaatctcgatttttgttcaacatccttagtgtcgatgtttttttttttcaaatatgcagctcgatcgacatgaagacgagcatgaaaaaacatattttgtaaacacattagccaaaagatgatatactatgagcctagattaactttatgtgtatacacacacaatattttagtatggaatacggtttctttgataaccgaacagatttgagaggattgaaggaggtataaaggattaaatcccgctcaatcctctctaagctccaaccccttgttttagaatagaacgatcaaagcggaattaaaacagtttggtagagaaagttgcctacactacc

SEQ ID NO: 509 - DNA, 2156 bp, Panicum virgatum
gtgagtgtgcgtgcgtttatgagcatttgcatctgtactgtttttttggagaaaaaaaagaagcagactcggtaccaatgctagcataagtacctggttttctttatgggttacttcaaaagaaaagtattttcttctcatcacaaatgatgtgtaggtgtgatggtaagcaagatacatgagaggtaagaattcccgagttcgaatgtgggccactgcacacatgcgtaattcgcgtgaaaaataatgtgacttatgatgtgcacgcgtgtggacttttttttaacaaaaactaccctgatatagaagaaggcattaggtaccgagtgttttacccggtgacgaatatcggttccctagtactagttggaaaaccggtgctgatggcgtgttttctaatagtgaatattaaaatccaaatcatattgagcgtataaattgtatcttccattcggtctgaagttcccgtcttcctcgccactttgctttctacgccctgccacgtaaaatccacacctgatctttcccaacagcgccggggcgccgactcgcggccagccatggcgatcaaaggtgagcaacagccgctgcgcatcctcttcttccctttcctaacgccggggcacctcatcccggccgccgacatggccgcgctcttcgccgcccgcggcgtcaagtgcaccatcctcaccacccctgtgaacgccggggtcatccgcttagcggtggaccgcgccaacgaggcctcccgcggcaccgaggacgccctgtccatcgacatcgctgtcgtgccgttcccggacgtcgggctgccccccggcgtcgagtccgtgccggccctgaacttcgatgccgacggcgacaagttcttccgggcgatccagctgcttcgggagtccttcgaccggttcctgacgcagaaccgcaccgacgccgtcgtgtccgacagcttcttcgactggtccgtggacgccgcggcggagcacggcgtcccgcggctggcgttcctcggcaccagcctgttcgcgcgggcctgcagcgactgcacggtgcgccacaaccccgtggaggccgcccccgaggaccccgacgcgcctgtgctgctgcccgggctgccgcaccgcgtcgagatgaggcgcagccagatgatggagcccaagaagcggcctgagcattgggccttccaccagcgcttgaacgccgcagaccagaggagctacggcgaggtgttcaacagcttccacgagctggagccggaatacgtggatcactacaccacgacgctcgggcgccgcgcgtggctcgtcgggccggtcgcgttcgccagcaaggacttggcgacgaggggcgccgacgacggcctctcgcccgacgccgacggctgcctgcggtggctcgacacgaagccggccgggtcggtggcatacgtgtccttcggcacgctgtcccgtttctcgccgcccgagctgcgcgagctcgcgcgcggcctcgacctgtccggcaaggacttcgtctgggtcgtcggcggcgcggacgccgaggagtcggagtggatgcccgacgggttcgcagagctgctggcgcgcggcgagcgcgggctcgtcatccggggctgggcgccgcagatgctgatcctgaaccacgccgccgtgggcggcttcgtgacgcactgcggctggaactcgacgctggaggctgtgagcgccggcgtgccgatggtgacgtggccgcggtacgccgaccagttctacaacgagaagctggtggtggagctgctcaaggtcggggtcggcgtcgggtccacggactacgcgtcgaagctggaggcgcggcgcgtgatcggcggcgatgtggtcgccgaggccatcgggagggtgatgggcgacggcgagggggcggaggcgataagggagagggccagggtgctcggggagaaggccaggagcgccggggaaaagggcgggtcctcgtacgatgacgtcgggcggctgatggacgagctgatggctcgcaggggcctcgtcaatgtctgattggtggaagcgcgtcaaaagtggaaggctgcggttgattttttaaaatactttatctattatcttaatataataattttaaaagaaacaactacgtctgccgagtagaaattacgggacgct

SEQ ID NO: 510 - DNA, 1676 bp, Pennisetum glaucum
gcggcccagccaaccatggcggtcgtagatgagcagcggccgctgcacatcctcttcttcccgttcctggcaccggggcacctcatcccggccgccgacatggccgcgatcttcgccgcccgcggcgtcaagtgcacgatcctcaccaccccagtgaacgccgccgtcatccgctcggcggtggaccgcgccaacgatgccgagggcgccctcgccatcgacatcaccgtcgtgcccttccccaacgtggggctgccccccggcgtcgagagcgggccggcgcttaactccgaggccgaccgggccaagttcttccacgcgatccagctgctccgggagcccttcgatcggttcctgaccaagaaccgccccgacgccgtcgtgtccgacagcttcttcgactggtccgtggacgccgcggcggagcacggcgtcccgcggctggcgttcctcggcagcagcctgttcgcgcgagcctgcagcgtcagcatgctgcgccacaacccactggaggctgcccccaatgaccccgacgcgctcgtgctgcttcctgggctgccgcaccgcgtcgagctgaagcgcagccagatgatggatcccaagaaacggccggaccaatggaccttcttccagcgcgtgaacgatgcggaccagaggggctacggcgaggtgttcaacagcttccacgacctcgagccggactacctggagcactacaccacgacgctcgggcgccgcgcgtggctcgtcgggccagtcgcgctcgccagcaaggacgtggcgacgaggggcgccgccgccaacgggctctcgcccgacgcggacggaatcctgcggtggctcgacggtaagccggccggctccgtggtgtacgtatccttcggcacgctgtctcatttctcgccgcctgagctgcgcgagctcgcacacggcttggacatgtccggcaagaacttcgtctgggtcatcggcggcggcgcggacaccgagaagccggaatggatgcccgacgggttcgtggagctcctggcgcacggtgaccgtgggctcatcatccggggctgggcgccacagatgctgatcctgaaccacgccgccgtgggcggcttcgtcacgcactgtgggtggaactcgacgctggaggccgtgagcgccggcgtaccgatggtgacgcagtggccgcggtacgccgaccagttctacaacgagaagctggtcgtggagctgctcaaggtcggggtcggcgtcgggtcgaccgactacgcgtcgaagctggaggcccgccgtgttatcggcggcaaggttgtcgcggaggccatcgggagggtgatgggtgacagtgaggaggcggaggcgattagggagcgggccagggtgctcggtgagagagctaggcgcgcggtggagaagggtgggtcctcatacgatgatatcgcacggctgatggacgagttgatggctcgcaggggatcgtgaatagtaggtggaagtatgccgaaagtcgtgagtgggacactgcggtttggtggcgtatgctcatcgaattgaatgaatgaagaatggttgtcgtcaaagctaggtcagtctgctccctccatccaaaaacaatgccgttttcggattcaaatttgtccaaaaaataataaaataatgttttacttaatttggtatgtgcc

SEQ ID NO: 511 - DNA, 1904 bp, Setaria italica
tctttgccactccgctttctacgccctgcctcgcaaaatccatacaaaaagagtgtccacctgatctgttcccaacagcgccggcgccggctcgcggccagccatggcgatcgaaggtgagcagcggccgctgcacatcctcttcttcccgttcctctcgccggggcacctcatcccggccgccgacatggctgcgctcttcgccacccgcggcgtaaagtgtaccatcctcaccacacccgtgaacgccgccgtcatccgctcggcggtggaacgcgccaacgacgccgagggcgccctggccatcgacatcgccgtcgtgcctttccccgacgtcgggctgccccccggcgtcgaaagcgggccggctcttaattcggaggccgaccgcgggaagttcttccacgcgattcaacagctccgggagcccttcgatcggttcctggcggagagccgccccgacgccgtcgtgtccgacagcttcttcgactggtccgtggacgccgcggccgagcacggcgtcccgcggctggcgttcctcggcagcagcttgttcgcgcgggcctgcagcgttagcatgctgcgccacaaccccgtggaggccgcccctgatgaccccgacgcgtccgtgctgcttcctgggctgccacaccgcgttgagctgaggcgcagccagatgatggatcccaagaagcggccggaccactgggccttcttccagcgcgtgaccgacgcggaccagaggggctacggcgaggtgttcaacagcttccacgacctggagccggactacctggaacactacaccacgacgctcgggcgccgcgcgtggctcgtcgggccggtcgcgctcgccagcaaggacgtggcgacgaggggcgccgccgccaacgagctctcgcccgacgcggacggctgcctgcggtggctcgaaggtaagccgtccggctcggttgtgtacgtgtccttcggcacgctgtcccatttctcgccgcccgagctgcgcgagctcgctcgcggcctcaacctgtccgggaagaacttcgtctgggtcatcggcggcacggacaccgaggagcaagagtggttgcccgacgggttcgcggagctcctggcgcgcggcgaccgtgggctcatcatccgcggctgggcgccgcagatgctgatcctgaaccactccgccgtgggcgtcttcgtgacgcactgcgggtggaactcgacgctggaggccgtgagcgccggcgtaccgatggtaacgtggccgcggtacgccgaccagttctacaacgagaaggtggtcgtggagctgctcaacgtcggggtcggcgtcgggtccactgactacgcgtcgaagctggaggcccggcgcgtgatcggcggcgaggtggtcgcggaggccatcgggagggtgatgggcaacggcgaggagggggaggcgataagggagagggccagggtgctcggggagaaagctagactcgcggtggagaagggcgggtcctcgtatgatgatgtcggacggctgatggacgagctgatggctcgcaggggattgtgaatatctgattggtggaagcacgtcaagagtgggagactgcggatttggcggcgtatgcaaatctgaattgttttcggggattcgcttttaagtacaggggttaggaccgtggtaacattgtacaaccggtattactacttcagtacttttgtagttagttcccggtcaaataatcgatactaaggggagtctgatttgccattactacctcgtctaaaagaaatctacggagttgttcctgaattgctctgattttttccatctcgaggagtgcttccttcatatctctcatctatgtcattggcaaatgctattatatagtagattaatggatctccacaattag

SEQ ID NO: 512 - DNA, 1117 bp, Aegilops tauschii
tacgtaggctcccagcagccatccgtgagagcaacccgagcaatattttaatccttgcacccgtgagcggtgagcggagcacggagcaggtcgagtggcgtccatccaattccaaccccgtgggactggcgtcgcctttcgccgaaccaccccaaacgactgaccggcgaagcatctttgcgctgcaccctacgtccctaccccggcagcggtcagaccggcgtctcgtctcgccgttatataagcgcgccccccgcacctccagaacctcacaaacacatcaatcaagcaagcagcacattcttgtgggactctgatcagtctcggcctctcagggaaggaagagaagagactgcttggtgaagtcgctggtttcgtgtgatcaagagctcgggtatggagttggagatggtgagccagcacggggcgctgctgaaggtggggctgttcgtgctggtgcaggcgctggtgtacctcatcctcgcccagtcctcctccgtcttctccaccaccaagaccctctgtctgcccccggcgcgctccctcagcgcccgccgcatggtcgcgctgctctccgacctgccgctgccgctcggcggcgagccctcgccccgcgccgccttcgtggagccgccgtcgcccgtacccctcgcccaccagaagaaggattagttattaaccaagcgcgactggcggcagggacacggaccgagctagcaagcgatcgtttccgagctactagtagtagtactcggtgcgtgctgtaggagctattcacgccattctttcattgattggttattggtttgttctttgggattggatatgtaaactgagctacacgccgtttgggtttgtacaatcaagtgaagattatgttttggctaccgtgcaatgcgtacgtgcttgtgttttgaggagaaacttctgaggaatggaacagttttgttcatatcatgaaactctccaaatggttttgttttcgtatttttatatgtgcattgtaatgctcaggatgtccttgcatacgcgatttctaaatagaaacttcttcttttcttctaggagtaaaagtttaggacaacgctaacgcccacacgtgtgatgggagtcaaac

SEQ ID NO: 513 - DNA, 858 bp, Aegilops tauschii
gcaaaggattgaagtgataagtcatgtcttccttttcttgtcgcttctctgatctcagcacataacctccatatatgcgcgaccatcctttaatctctccgcaccaacgaacttcaaaaactattctcaacacttgtgcacacgcaaagattccatgggagcgaagctttcctgcttctccaaccacggaggcagcctctcgcagcagccacaccagccggcgcctgttagggtcattgccgccgacggatcgctgaaggagctcccggccagcccacgcgtcaccgtctccaacgtgctcggcggcagcgccgcgtccttcttcgtgtgcagctccgacgcgctctacttcgaccagagccctccggcgctggcatccggggaggtactccagtcggggcagatatacttcctgctccccgcggcccccccccccccccccccccccccccccccccccccccccccccccccccccccccggcggtgggggcgagaaaagccgcagcgggggcgggggcgcctcagcggcgggaggaagaaggtgcgcgtcatgccgatgcacgaggaggtggaagacggcgaggatgttctgctgaacgagaagcttaacgagcggacgctcggggagttcgccgtgtcgccgatgagcccagagaagatcggcgtggtggcggcacggtcgcggctgaagatgaagctgaagcgcgctctgagtatcattcaagaggttgctgagtgaagcatttctctaaaagataaatactagtggtgtttttttttagtttttggttctgtttgaagccatatttaggtttaagcccaaatatttaattggtttagttgatttaggctcgg

SEQ ID NO: 514 - DNA, 1137 bp, Secale cereale
ccgccgtgctccgcttctacgtggtgtaaccaagaggggaagaggagaaatggcaagctaccaccgggtccacccggtgatcgtcgacggcgcgccggagcagaacaaggacaagcagccgccgccacccagcgccgcctatggtgaccggctgccgatcaccgccccggcgccgggcgcggcggccccgctgcgcgcgccgcggcggaagcgccacagccggtgctgccggtgcgtgtgctgcacgctgctggtgctgatcgtgctggtcgtcgcgctgggcgccacggcggggatcctctacgccgtgttccggcccaagatccccacgttccgcgtggagcggctcacggccacccggttcgacgtgaacaccacctccatgacggtgtcggacgcgttcgaggtgcaggtgacggccgagaacccgaaccggcgcatcggggtgtactacgacggcggctgggtcgccgcctccttcaacggcaccgagctgtgccgcggcgcgttcccggtgctctaccagggccaccgcagcacggtgcggccgctcatcacgctcgagggggagaccaggctcgacagcgccgtggccgcgcagctcgcgcagcagcgccaggccgggttcgtgccgctcacggtcaccgcgcgcgtgcccatccgcatcaagtttggcgccctcaagctgtggacgatgaccgggaaggcgcggtgcagcctggtggtcgacagcctcgaggccgggacgcggctccgcatccgctccaacatctgcaccttcaagctcaagcctaattaaatcattctcaaaccgtttgagccgtgcacggattgtgcatatatactcgcgtgtctttgtatgtaggattaccgaggtctcgtccccattcctgtccatctatattgattcagatcggcacatggtacgtagagatgggtagtgctgtaaatttattatttattttgattaactcgtatattcactgtttttagtgaaataaataagatcgaggtctattcatttactatcagtttctttgtagaagataataaagagaacagttttagactaaaaaaaaaaaaaactagagactacgcaacgacgacacgaagggagtaaggcgacccccccccccc

SEQ ID NO: 515 - DNA, 1078 bp, Secale cereale
caaacttccttcagatttcagcgaaccaactcatcccgccgtgctccgcttctacgtggtgtaaccaagaggagaggaggggaaatggcaagctaccaccgggtccacccggtgatcgtcgacggcgcgccgcccccggcgccggagcagaacaaggacaagcagccagcgccggccagcgccgactatggcgaccggctgccgatcaccgcccctgcgccgggcgcggcggccccgctgcgcgcgccgcggcggaagcgccacagccggtgctgccggtgcgtgtgctgcacgctgctggtgctgatcgtgctggtcgtcgcgctgggcgccacggcggggatcctctacgccgtgttccggcccaagatccccacgttccgcgtggagcggctcacggccacccggttcgacgtgaacaccacctccatgacggtgtcggacgcgttcgaggtgcaggtgacggccgagaacccgaaccggcgcatcggggtgtactacgacggcggctgggtcgccgcctccttcaacggcaccgagctgtgccgcggcgcgttcccggcgctctaccagggccaccgcagcacggtgcggccgctgatcacgctcgagggggagaccaggctcgacagcgccgtggccgcgcagctcgcgcagcagcgccaggccgggttcgtgccgctcacggtcaccgcgcgcgtgcccatccgcatcaagtttggcgccctcaagctgtggacgatgaccgggaaggcgcggtgcagcctggtggtcgacagcctcgaggccgggacgcggctccgcatccgctccaacgatctgcaccttcaagctcaagcctaattaaatcattctcaaaccgtttgagcccgtgcacggattgtgccatatatactcgcgtcgtctttgtatgtaggattaccgaggtctcgtccccattcctgtccatctatattgattcagatcggtcacatggtacgtagacgatgggtagtgctgtaattattatttattttgattaactcgtatacttcactgttttagtgaaataataagatcgaggtctaagttccaattt

SEQ ID NO: 516 - DNA, 1197 bp, Hordeum vulgare
atcaactaccacaacatcttctttctgcaaaccagttcttcctgcgacggtgctctccttttacgtgctgtaagaagcaagcaagcaactaggaggctaggagctagctagccagccaggtgaagagagcatggcaagctaccaccgggtccacccggtgatcgtcgacggcgcgccgctccctgcgccggagcagaacaaggacaagctgccaccgccaccaaacgccgactatggtgaccggctgccgatcaccgcccctgcgccggacgctccggcaccgctgcgcgcgccgcggcggaagagacacagccggtgctgccggtgcgtgtgctgcacgcttctggtggtgatcgtgctcgtggtcgcactgggcgccacggcggggatcctgtacgccgtgttcaggcccaagatccccacgttccgcgtggagcggctcacggccacccggttcgacgtgaacaccacgtccatgaccttgagggacgcgttcgaggtccaggtgacggccgagaacccgaaccggcgcatcggggtgtactacgacggcggctgggtgtccgcgtcgttcaacggcacagagctgtgccgtggcgcgttcccggcgctctaccagggccaccgcagcacggtgcggccgctgatcacgctcgagggggagaccaggctcgacagcgccgtggccgcgcagctgctgcagcagcggcaggccgggttcgtgccgctcacggtcatcgcgcacgtccccatccgcatcaagtttggtgccctcaagctttggaagatgacggggaaggcccggtgtaggctggtggtggacaacctcgaggctgggagacggctccgcatccggtccaacagctgcagcttcaagctcaagccttagatcattctcaaaccgtttcagccgtgcacggattgtgcatacgtgtcttgtatgtaggattaccgtggtctcgtccccatttctgtggatctatgttgcttgagatcggcagacggtagagagatgggtagtgctgtaaatttattgtttattttggcttgtattcattattcttagtgaaataagatccgaggtgtattcatttgctacgaattcctccggagaaggtaataaagaggacatgttatgttaccccttcgtctcccctcctaggggttttgccttcccccggcggcaccttctatctg

SEQ ID NO: 517 - DNA, 1153 bp, Avena sativa
agtagctcttcattgatccattcccattccgccgccgtcttcgacttctacgatcgtactacctggtgtaagcaagcaagcaagaaagctctcgatcgcatggcagactaccaccgggtccatccggtgatcgtcggctcgccgcttccggcgcaggagcaagccaacaaggacaagcaaccgcccagcgccactcatggcgacaagccgctgctgccggtcaccgccccgccgccgtacgcgccggcgccgctgcgcgcgccgcgccggaagaggcacagccggtgctgccgctgcgtgtgctggaccctcatggcgctcatcatcctcgtcatcgcgctcggcgccaccgcggggatcctctacgcggtcttcaggcccaagatccccaccttcaacgtggaaacgctcacggtcacccgcttcgacgtcaacaccacctccatgacggtcaccgacgccttcgaggtgcaggtgaccgcggagaacccgaaccggcgcatcgggatctactacgacggcggcgaggtgacaacgttcttcaacggcacggagctctgcagcggcgccttcccggcgctctaccagggccaccgcaccaccgtgcgcccgctcatcacgctgcagggggagaccaggctcgacagcgccgtcgccgcgcagctcgtgcagcagcagcaggccgggttcgtcccgctcaccgtcaacgcgcgcgtgcccatcagatcaagttcggcgcgctcaagctgtggaagatgacggggaaggcgcgatgcgacctcgtcgtcgacagcctccaggccgggacgcagctccgcatccgctccaacagctgcagcttcaagctcaaagttgtttagacaactttctctgcttctcaaattctttgagccgtgcacatggtctatctatgtgtgtgggaggattaccgagcgaggtcacatacgtccccaccatgcatctctgcggatctgtattgcgggagatcggcaggtgtggttggtagagatgtgtatgtaaatttattgtttattattttggctcgtatattcattatttttagtgcaataagatccgatgtgtgtaatctgttttaccatgagttactttggagaatagaattaataaagagggatactactagttcatgcac

SEQ ID NO: 518 - DNA, 467 bp, Secale cereale
ctctcaaagcctcgctcgaatcaatagctagcagcctcgaatcatattcatcaccatggcgtctgccggccgccgtcccacggtgctcctgcagatcgctctcttcgtcgtcgtcgcggcggtcatcgtcaacagctccgtctgccttggagccgacgccactgcaggctctggtgctttcgaccctaaccgccctgctgtcccgtcgacgggtggtgctggtaaaccctacaccggccgtgggtgcctccgtaactacggctgctacccaccggctgctggccaaccctaagtaacatgcacccgtcccccagaaataatgcaagggtcgatcgatatatatgtaactgaacaacggcctccgacgtgtcagcgcaagttactctactgccacgcatcactttatgcatagtaatattgtctcctgtactatttacactctgaataaaactggatatatgttgctg

SEQ ID NO: 519 - DNA, 460 bp, Secale cereale
tcaaagcctcgctcgaatcaatagctagcagcatcgaatcatattcatcaccatggcgtctgccagccgccgtcccacggtgctcctgcagatcgctctcttcgtcgtcgtcgccgcggtcatcgtcaacagctccgtctgccttggagccgacgccactgcaggctctggtgctttcgaccctaaccgccctgctgtcccgtcgacgggtggtgctggtaaaccctacaccggccgtgggtgcctccgtaactacggctgctacccaccggctgctggccaaccctaagtaacatgcacccgtcccccagaaataatgcaagggtcgatcgatatatatgtaactgaacaacggcctccgacgtgtcagcgcaagttactctactgccgcgcatcactttatgcatagtaatgttgtctcctgtactatttacactctgaataaaactggatatatgtt

SEQ ID NO: 520 - DNA, 504 bp, Echinochloa colona
ctgatccctagcggaggagaaggcttgcaagagatcatgggaagggcgtcctggaggtgcacctcgtcgacgccaagggcctctccggcagcgatttcctagggaagctggacccctacgtgatcatccagtaccggagccaggagcgcaagagcagcatcgcccgagaccaggggaggaacccgtgctggaacgaggtgttcaagttccagatcaacaccgccgcgtccaacgcccagcacaagctcgtcctccggatccttgaccacgaccacttctccagcgacgacttcctcggcgaggcgacgattgacgtgacggacatcatcagcctaggcgcggagcgtggcacctaccacctgagcgcgggcaagcacagcgtcctcctccccgacaacacttaccacggcgagatcaaggtcggcatcaccttcaccgcagctcagggtcaggaggatggagtggagattggagggtggaggcacagcagctttaatcagtagg

SEQ ID NO: 521 - DNA, 2506 bp, Echinochloa colona
ccggggtcggcgcgtcccgggaaacagagagggaggcagcgcagccggcagcgtgagaagagctgcgccgcccgggcgcggagtggtggaggcagtaggccacagcccggagggaggaaggcgccggccgagatggatatcacggaggtcacggtggtgcaccacgccgcgctcgtgctggcggcgctctgggccgccgcggccgccggctgggcgcacccggcgctcttcctcgtcgcgctcctctacatcttcgcggtgaatgaaaggtacacaatgagactgaggagaaggctacagtatgaggaaaggaaatgtgccagtcagagaaagcttctctctgatgcagaaactgtcaggtggttaaattatgctgtggaaaagatctggccagtttgcatggagagggttgcatcccagcagttcctttttcccatattcccgtggttcctagagaagttcaaaccatggacagcaaggaaagcagttatccaaagcctttacttgggtaggaacccaccaatgtttacagatattagggtggttaggcaatcaactgatgatgatcatttggttctggagatagggatgaattttctttcagcagatgatatggatgcacgaatggctgtacaactgaggaagagattaggatttggcataacagcaaacatgcatataactggtatgcatgttgaagggaaggttctagtaggggtgaggttcctacaacagtggccattcattgggcgggtgagagtgtgctttgttgagcctccatacttccaaatgacagtgaaacctttatttggccatgggcttgatgtaactgagctcccaggaatttctggatggcttgataggatgttggatgttgcgtttggacagacccttgttgagccaaacatgctagttattgatctggagaagtttgcctcggaatcaacagagaactggtttagtgttgatgagaagccacctatcgcacatgcacgggtggagatcatggaaggtgctgacatgaagccatctgatccaaatgggctagctgatccatatgttaaaggtcatcttggaccctaccgttttcagacgaagattcataagaaaactctcaacccgaaatggcttgaggagtttaaaataccaattacatcatgggaagcactcaatcttctctctcttcaagtccgagacaaggatcccatctttgatgacactctaggtgattgttccataagcatcaacaaattaagaggtggacaaaggcatgatatatggatttcactgaagaatataaagacagggaggattcacattgctgtaactgtacttgaagaagaaaatgaaaaggttccttgtgatgaagaggagcagggtggaacacccaaagtgggtaaagctagcaccccaaggtcaagctttcgtccaggaccaacaacgaaagtgaatcctccgaggaattccggaagatgtctgatgaatttgagcctgttgacatcgaaggatcagaaaagcctgatgtttgggtacatcggccgggcagcgacgtcaccagtacatgggagccccggaaaggccgtcctcgatgccaggattccaaaatccagcgggagaatgatgcttccagtgatagtccaaggtcatcagtgtcagaatctcacagaagcgactccagcaccgaagaacccacgagtggtaaatctcatcgtcacctccgtaaggtcaagaagggtttgggcaagctagctggagcagtgttccaccggagcccaaagaaagagaccgatgacgaagcttcctcctgtgtgacatctcaccctaacattcgacctgttggagaaagcagggtgtcggtaacatatgtggttgatcaagatcctgggagcagcagaaaggggacgagaacagatgagcagcagcactcaagccctgagagagaggagccggacagtccgaccaagaggcacctgagaaagaaagcagctcacatggtaaagcatgcgggcaaagcagctcataacctgaagagcatgttcagcaacaagagcctcgacaagagaaaagaagagtgccaaaacgacgaggaatgtgaggttgttgccatgaaaatagacggggtggcagttgatcctcctgtaccaagtaacgatgccgttgatccgccggagtctgtaactgatggcaaggacaaggtgcagtgaaacgtagtctgcgtgattgcgttctgctgtgtatgcaaagtgaccttgttctgagcctgtgtaggaattaggatagtaggtagtttcctgttagtcccctgacaacatacatagaggtcagatctgaaagtgctaggctggtcgagggttcctaagtgtccttggcttatggtttttgttgtgtattcaggctcgagacataacatctgtaaatattcgggagctattccctcccacctgcgaaccagatcctctgcagtaatacgttttttgtaagagggacgtgattacgtgaatacaag

SEQ ID NO: 522 - DNA, 3154 bp, Panicum virgatum
cggaaaggagagaaaaacccactcacgcggcatcggcgcccgcacccacaacaaggcccccgcccgcgcggctgcccatgtgacgagctccccggccgccacgttcccccgcggccgccgccacgcagcgccagcgcgctcggagaaaatatttttcccaaatccccccgccgccgcccacccaccaccaccgggccaaccagcggagcaggtggtgctgatgacggcagctcccgcacccgcagctcggggcgcggtcgccgcgtgagagagagagagagcacgcccacaccggctggctattttactgcgcccccgccgcggtcgcggctctcgcctttccgcccgcggcccgccgcttttcgtccccccgcgtgtggcctgttggcctccctcgctccgccgtctcgtcggctccccggcacggacacgcgcggcgttcgcacggggttccggctgtcctgaggaacagcgagagcaggagcaggagcggtagtgcggccgcgcgcgccgcaggccactggaccgggcaccagcggaggaggctgccgccggcccgtgaagtgaaggaccctcgccgcgatggatatcacggaggtcacggtggtgcaccacgccgcgctcgtgctggcggcgctctgggctgccgcgtccgccggctgggcgcacccggcgctcttcatcgtcgcgctcctctacatcttcgcggtgaatgaaaggtacacaatgagactgaggagaaggctacagtatgaggaaaggaaatgttcgaatcagagaaagcttctctctgatgcagaaactgtcaggtggttaaattatgctgtagaaaagatttggtcagtttgcatggagagagttgtatcgcagcagttccttttgcccatattcccgtggttcctacagaagttcaaaccatggacggcgaggaaagcagttatccaaagcctttacttgggtaggaacccaccgatgtttacagatattagggttgttagacaatcaactgatgatgatcacttggttctggagatagggatgaattttctttcagccgatgatatggatgcacgaatggctgtacaactaaggaagagagtcggatttggcataacagcaaacatgcatataactgggatgcatgttgaagggaaggttctggtgggggtgaggtttctgcgacagtggccgttcattgggcgtgttagagtgtgctttgttgagcctccatacttccaaatgacagtgaaacctttattcggtcatgggcttgatgtaactgaactaccaggaatttctggatggcttgacaggatgttggatgttgcatttgggcagacccttgttgagccaaacatgcttgttattaatctggagaagtttgcctcagaatcaactgagaactggtttagtgttgatgagaagccacctatcgcacatgctcgcgttgagatcttggaaggtgctgacatgaagccatctgatccaaacggactagctgatccatatgtgaaaggccatcttggaccctaccgttttcagacgaagatccataagaaaactcttaacccaaaatggctcgaggagtttaaaataccaattacttcatgggaagcgctcaatcttctttctcttcaagtccgagataaggatcacatctttgatgatactttgggtgattgttccgtaagcatcaacaaattaagaggtggacaaaggcatgatatatgggtttcgctgaagaatataaagacagggaggattcacattgctgtaactgtaattgaagaagaaaatgaaaaggttcctaatgatgaagaggtgcagggtggaacgcccaaagtgggcaaagcttgcacaccgagttcaagcttttcatccaggaccaacaacgaaagtgagtcctctgacgaaatccggaagatgtctgatgagtttgagcctgttgacatcgaagggtcccaaaagcctgacgtttgggtacatcgcccgggcagcgacgccactagtgtatgggagccccggaaaggccggcctcgatgccaggattccaaaatccaccgggagaacgatgcttgcagtgatagcccaaggtcatcagtgtcagaatctaacagaagtgattccagtactgaagaacccacgagtggtagatcgcaccgtcacctccacaaggtcaagaagggtttgggcaagctagctggagcagtgtttcaccggagcccaaagaatgggaccgacgacgaagcttccccatgcgtgacacctcaccctaacattcagcctgttggagaaagcagggtgtcagtaacatatgtggtcgatcaagatcctgggagcaacagagaggggactagaacaaaggagcagcagcactctagccctgagagggaggagctggacagttcgagcaggaggcacctgaggaagaaggcagctcacatggtcaaacatgcgggcaaaaccgctcataatctgaagagcatgttcagcaagaaggacctcgacaagagcaaggaagaatgccaaaacgaggaggttggtgatgtcgctgcgatgaaaatagatggggtggcagttgatcctcctgtaccgagcaatgatgtcgtcgagctgccggaatctgtagctgatgatggcaaggacaagggcagtgagacgtagtctgcgttcagctgtttatgcaaagtgaccttggtctgagcctgtgcaggatagtagttagttatctcagatagtcccctaacacccaacatagaagtcggatcttgagaaatgctaggctggtcgacggtttctgtgtgtgcttaacccatatggtttctactgtgtattcagggctcgaggaacgtctgtgaatattattatgtacattctcgaaaatgtccttacgactcaattagaaacattgagttcaagatacaatatgtcagcctgacaacagtttattgaacaagtagaaacacgaattcaagtacgtcgaatgtggtgagttcaattttttagtgggtgtagttaccgggcgtaactttttttcttacacacataaatactctcccctataaacatactcctatgtatcggtaacctatcctacaagtacattcgagtatcaccgcagatgacttagtgtaaggaacatggtcacattagg

SEQ ID NO: 523 - DNA, 2578 bp, Zea mays
aaaaatttctgtgaccatcttagtaccgtggatcacaaatttcatcaaaaaaagattcctcttatagggcaaggagcatgataatccaatgcagaaactgtgttcagcacagaagatcgagcgaatacagtttttcaattatctcatctcagtaacaatatgatttttaggtgaatcaacgatacacaatgaggctgtggaggcggatacagtatgaggaaaggaaatgtgccaatcagagaaagcttctctctgatgcagagactgtcaggtggcttaattacgctgtggaaaagatttggccagtttgcatggagagggttgcatcccagcagttccttttacccatattcccgtggttcctagagaagttcaaaccatggacagcaaggaaagcagtaatccaaagcctttacttgggtaggaacccaccgatgtttacagatattagggtagttaaccaatcaaccgatgatgaccacttgaccgtgaaacagctaaaatttacatgccaggttctagagatagggatgaattttctttcagctgacgatatggatgcaagaatggctgtgcaactaaggaagagattaggatttggcattacaacaaacatgcatataactgggatgcatgttgaaggaaaggttctggtaggggtgagatttctgcggcagtggccatttattgggcgtgtaagagtatgctttgttgagcctccatacttccaaatgacagtgaaaccgctgtttggtcatggacttgatgtaactgaactcccaggaatttctggatggcttgacaggatgctggatgttgccttcggacagacacttgtggagcccaacatgctagttattgatctggaaaagtttgcctctgaatcaacaggcccattttcctttatacacttagctaaatcacttatgcttaggcatgcagctgtacaggggaaacatttgttagctgcagataactggtttagtgttgatgagaagccacctatcgcatatgctcgagtggagatcctggaaggtgctgatatgaagccatctgatcctaatggactagctgatccatatgtgaaaggacaacttggaccctaccgttttcgcacaaagatccataagaaaactcttgatccaaaatggctcgaggagtttaaaataccaataacttcatgggaagcactcaatcttcttcatcttcaagtccgagataaggatcccatttttgatgacgctcttggcgattgttccataagcatcaacaaattaagaggtggaataaggcatgatatatggattgcactgaagaacataaagacagggaggattcacgttgctgtaactgtacttgaagaagaaaatgaaaaggtttctaatgatgaagaggaacagtgtggaatacacaaggttgacaaggctagcacaccgaggtcaagtttctcctccaggaccaaccatgaaagtgaatgttctgatgaattccggaagatgtctgatgaatttgagccagttgacatagaaggatcggaaaagcccgatgtttgggtgcatcgccctggcagttatgtcaccagtacatgggaacctcggaaaggccgtccccggtgccaggattccagaattcaccgggagaatgattcttgtagtgatagcccaaggtcatcagtgtcagaatctcatagaagtgactccagcactgaagaacccacgagcagtaaatcgcatcgccaccttcaaaaggtcaagaagggtttgggcaagctagctggagcagtgctccaccggagcccaaaggagaatgatgacgaagcttccccatgtgtaactcctcaccaaaacattcgaccggtcggggaaagcagggtttcagtaacatatgtggtcgatcaagatccagcaggggtcgacggatcggggtcgagacgagatgaccaccagcaaagccctgagagagaggagctggacagcccgagtaaaaggcatctgaggaagaaggcggtgcacatggtgaaacatgctgggaaaaccgctcataacctaaagagcatgttcagcaagaagggccttgacaagagcaaagaagaacaccgcagtgatgaggaatgcgacgaggaaggcgacgttgttgctgctagaagagtgtagaatatgcaagacttagttctattcctttggggttgtagtatacatatagtatgtactgatgaagtgttgcacaaggaggcgcttgggccatgggtctcatcggctaaatagagtattacatgccacatttgacaccctctcacaaacttagacttaggtgaagcttttgatcatgaatacgttccgtttgacggtgttacactgattttcgacgactactaaagtcataatatttagaccgcactaactgaccgtcaaaacataatttaacataaaaaatctatcaattaaaataaagtaaaatttgaagtgcttgattatttcaggagaatgatttttgtttgctaataattgattgatgcttttattaataactattcaaaatctagtttattaatatacgaactttggtctaaaaataaaat

SEQ ID NO: 524 - DNA, 3220 bp, Setaria italica
aactactctcgcggcatcggcgcccgcgcccgcacccgcatccccccgagcccccaggtgcccccgccccgcgccacgcgcccgcggcccatgtgacccgcatcccggccgccagcccgccacgttcccccgcggccgcgccacgcagcgccagcgcgctcgtagtcgcagaatatttccccatcccccgccgccacccaccaccgggcgtccgggccaaaccagcggagcaggtggtgctgatgatgacggctcgcgcatccgcagctcggggcgcggtcggcgcgtgagacagagagagggagggcaccccggcgccacgcccacatcggctgacgcgtcggctattttactgcaccccgccgcggccggactcgcctttccgctcaccgcccgccgctttttgtctcccccgtggcctgtttggcctccctcgtcctgccgtctcggctcccccggcacacgggcacgcgtagcgttcgcacggggttccgcccgtcctgaggaacagcgggagcaggagcgcaggccagcggaggaggaggctgccgccggcctgcgcaggacctcgccgcgatggacatcacggaggtcacggtggtgcaccacgccgcgctcgtgctggcagcgctctgggccgccgcgtccgctggctgggcgcacccggcgctcttcctcgtcgcgctcctctacatcttcgcggtgaatgaaaggtacacaatgagactgaggaggaggctacagtacgaggagaggaaatgctctaaccagagaaagcttctctctgatgcagaaactgtaaggtggttaaattatgctgtggaaaagatttggccagtttgcatggagcgggttgcatcccagcagttccttttgcccatattcccgtggttcctagagaagttcaaaccatggacggcaaggaaagcagttatccaaagcctttaccttggtaggaacccgccaatgtttacagatattagggttgttagacaatcaactgatgatgatcacttggttctggagatagggatgaattttcttgcagctgacgatatggatgctcgaatggctgtgcaactaaggaagagagtaggatttggcataacagcaaatatgcatataactgggatgcatgttgaagggaaggttctggtaggggtgaggtttctgcaacagtggccattcattgggcgtgtaagagtgtgctttgttgagcctccatacttccaaatgacagtgaaacctttattcggtcatgggcttgatgtaactgagctcccaggaatttctggatggcttgacaggatgttggatgttgcgtttggacagacccttgttgagccaaacatgctagttattgatctggagaagtttgcctcggaaccaacagagaactggtttagtgttgatgagaagccacctattgcacatgctcgggtggagatcctggaaggtgctgacatgaagccatccgatccaaacggactagctgatccatatgtgaaaggccatcttggaccctaccattttcagacgaagatccataagaaaactcttaacccgaaatggctcgaggagtttaaaataccaatcacttcatgggaagcactcaatcttctttctcttcaagtccgagataaggatcccatctttgatgacactctgggtgattgttccataagcatcaacaaattaagaggtggacaaaggcatgatatatggatttcactgaagaacataaagacagggaggattcacattgcagtaactgtgcttgaagaagaaaatgaaaaggttcttaatgatgaagaggagcagggtggaacacccaaagtgggcaaagctagcacaccgaggtcaagcttttcatcgaggaccaataacgaaagtgagtcctccgaggaattccagaagatgtctgatgaatttgagcctgttgacattgaagggtcagaaaagcctgatgtttgggtacatcgcccgggcagcgacgtcactagtacatgggagccccggaaaggccgtcctcggtgccaggattccaaaatccagcgggagaatgatgcttgcagcgatagcccaaggtcatcagtgtcagaatctcaaagaagcgactccagtaccgaagaacccacgggtggtagatcgcaccgtcacctccgcaaggtcaagaagggtttgggcaagctagctggagcagtgttccatcggagccccaagaatgagaccgatgatgacgcttccccatgcgtgacaccccacccaaacattcagcctgttggagaaagcagggtgtcagtaacatatgtggtcgatcaagatcctgggagcaacagaaagggtacggtaacagatgaggagcagcactcaagccctgagagggaggagccgaacagtccgaccaagaggcacctgaggaagaaggcagctcacatggtcaaacatgcgggcaaaaccaccgcccataacctgaagagcatgttcagcaggaagggcctagataagagcaaggaagagtgccaaaatgatgaggaaggtgatgtggttgcgatgaaaatagacgggatggcagctgatcctcctgtaccgagcaacgatgccgtagatgcgccagagtctgtagctgatggcaaagacaaggtgcagtgaaacgtagtctgtgttctgctgtatatgcaaatagccatggtctgagcctgcgtaggatggtaggtactagttaccacttaccaaatagtcccctagcaaccaacatagacatacaacaggatataaggcgttaagaaaaaaaaaagacatagacgtcagatcttgagaagtgctaggctggtcgtcgagggttcctgagtgtccttgatctatatggtttctgttgtgtattcaggactcgaggaacttgtgtaaatacatgtagattttggaagagttcttttatggctcaattgaatccaagagttccaagtttagcgcatgtcagcctaacaggtggcaacagtttcttggaacaagtacaaacacgaaatcaagtatgtcaaatttgttgtgtaccatactccctaagttcatttttggtggaccgcagtcggcgcataagttttttttacccatgtataaacactcacctaaattaacgcgtgcacctacactaaaccgctataagtacatcgaactacatcaattttgtaccacacaattcacatattattggtacatactc

SEQ ID NO: 525 - DNA, 2585 bp, Pennisetum glaucum
ctggactcgcctttccgctcaccggctgctgctttttgtctcccccggtgcccgtggcctgttggcatccaccgtctcggctcccccggcggccggcgcacgggcacgcgcagcgttcgcaggcacgggattgcgcgcgtcctgagggaacagcgggagcagcagcagcaggaagctgccgccggcctgcgcaggacctcgccgcgatggacatcacggaggtcacggtggtgcaccacgccgcgctcgtgctggcggcactctgggccgccgcgtccgccggctgggcgcacccggcgctcttcctcgtcgcgctcctctacatcttcgcggtgaatgaaaggtacataatgagactgaggaggaggctccagtacgaggagaggaaatgctctaaccagagaaaacttctctctgatgcagaaactgtaaggtggttaaattatgctgtgcaaaagatttggccggtttgcatggagcggattgcatcccagcagttccttttgcccatattcccgtggttcctagagaagttcaaaccatggactgcaaggaaagcagttatccaaagcctttaccttggtaggaacccaccaatgtttacagatattagggttgttagacaatcgacggatgatgatcacttggttctggaaatagggatgaattttcttgcagctgacgatatggatgctcgaatggctgtacaactaaggaagagagtaggatttggcataacagcaaatatgcatataactgggatgcatgttgaagggaaggttctggtaggggtgaggtttctgcgacagtggccattcattgggcgtgtaagagtgtgctttgttgagcctccatactttcaaatgacagtgaaacctttattcggtcatggacttgatgtaaccgagctcccaggaatttctggatggcttgacagaatgttggatgttgcgtttggacagacccttgttgagccaaacatgctagttattgatctggagaagtttgcctcggaaccaacagagaactggtttagtgttgatgagaagccacctattgcacatgctcaggtggagatcctggaaggtgctgacatgaagccatctgatccaaatggactagctgatccatatgtgaaaggccatcttggaccctaccgttttcagacgaagatccataagaaaactcttaacccgaaatggctcgaggagtttagaataccaatcacttcatgggaagcactcaatcttctatctcttcaagtccgagataaggatcccatctttgatgacactctcggtgattgttccataagcatcaacaaattaagaggtggacaaaggcatgatatatggatttcactgaagaacataaagacagggaggattcacattgcagtaactgtgcttgaagaagaaaatgaaaagattcttaattatgatgaggagcaaggtggaacacccaaagtggggaaagctagcacaccgaggtcaagcttttcatggaggactaataatgaaagtgagtcctctgaggaattccggaagatgtctgacgaatttgagcctgttgacattgaaggatcagaaaagcctgacgtctgggtacatcgcccaggcagcgacgtcactagtacatgggagccccggaaaggccgtcctcggtgccaggattccaaaatccagcgggagaatgatgcttgcagtgatagcccaaggtcatcattgtcaggatctcacagaagcgactctagcactgaagaacccacgagaggtagatcacaccgtcacctccgcaaggtcaagaagggtttggacaagctagctggagcagtgttccaccggagcccgaagaatgagatcgatgatgacgttttcccatgcgtgacacctcacccaaacattcggcctgttggagatagcagggtgtcagtaagatatgtggtggatcaagatcctgggagcaacagaaaggggacggtaacagatgaagagcagcactccagccctgagagggaggagccgaacagtccgaccaagaggcacctgaggaggaaggcagcacacatggtcaaacatgcgggcaaaaccaccgctcataacctgaagagcatgttcagcaggaagggactagataagagcaatgaagagtgccaagatgatgaggaaggtgatgttgttgcgattaaagtagacacgatggaatctgatcctcctgtaccgagtaacgatgccgtagatgcgccagagtctgtagctgatggcaaagacaagatgcagtgaaacgtagtctccgttctgctgtataggcaagtagccttggtctgagcctgcgtaagatggtaggtactagttaccactcacaggttacaagacagtaccctaacaaccaacatatacatacaacaggatatacaaggagttaaaaacgacatacggtcaaatctggagaagtgctagcctgctaggctggttgaggcgcgacttcatgcgcgagggtagatctttatggtttcattcagaactcgaggacgttgtaagagcatcttcaacagattgggtaaaccgtaaacacagtagctaatt

SEQ ID NO: 526 - DNA, 2268 bp, Panicum virgatum
gttccttttcttcctcatatgcatctagtttcttcctttgtttgaagctcttctcaatccggctagcaaatttaatttgttcttcataatttcttcagtcatcttataggatggttttgggagtttgcagagtaacttgtttcttgcttgagcttcttctatatatagttccattggcccagcttagtgtatttgaaaggggggccatgccgcctctccctcccccgacttttgaaaatctgcactaaatgttcagtaaatcagctactgtttattgattttcaagacaaaatatcatagctggcccctcctgattactcgctcaagctccgctagttcagtaattgatggagtgatcagtgctctgattgatgcagaaacagattttggatttcttttcccttttctgtaattagactaggaagaaaaatatctttttgttgggattgaagcttcatttctggttttgcccgaactgttcattcacctaacttgcttgtgtgacgcatgccatgacgcaggactgcaactgcgaacaaacttgcagcccggaagcatcgcaaacatgggaaatgccgctattccaatcatttcctcaatcgcaggaactgcgacggtagtagtgatgatcttccttatcaggagatgccgcgtcgtgaggaagaagatgaagaagaagatcgggaagaaaatcatggaggagattgagagaatgaaccgcgaggttcaagcctgcaaggccttggaagacgtggtgatcgagatcgggccggtggagaagttcctgaacgagatcctcaacgagaagcccatgcgtttcagctccgagcagctggcggcctgcacccggaactactcgtcggagctggggtccggcggcttcggcgtggtctacaagggcgacttgccgaacggtcttccggtggccgtgaaggtcctgaaggtgtccatgaacaagaaggtgcaggaggcgttcatggcggagatcggcaccatcggccggacgtaccacgtgcacctcgtccggctctacggcttctgcttcgacagggacaccaaggcgctagtctacgagttcttggagaacggctccctcgagaagtacctctacggcgacgaggagggcaaggcgccgaggctggagtggaggatgctgcacagcatcgccgtcggcacggcgaaggggatccggtacctgcacgaggagtgccagcagcggatcgtgcactacgacatcaagccggccaacatcctcctcaccgccgacttcaccccgaaggtggccgacttcgggctggcgcggctcggcgagcgggagaacacgcacatgtcgctgaccggcggcgggcgcgggacgcccgggtacgcggcgccggagctgtggatggcgctgccggcgacggagaagtgcgacgtgtacagcttcgggatggtgctgttcgagatcctggggcggcggcggaacttcgacccctgcgagggcgagagcaaggagtggttcccgaggtgggtgtgggagaagtacgagcagggcgagatcgagtgcgtcgtgtcctgcgacggcatcggggaggcggacagggacaaggcggagatgatgtgcaaggtggcgctgtggtgcgtgcagttccagccggcggcgcgcccgacgatgagcagcgtggtgcggatgctggagggggagatggccatcgtcccgccggcgaaccccttccactacgtgatggacagtagcagcggctcgttgagctcggggatgtggagcggcacgtaccagagcagcagggacaccaccggcagaaacagcgagctgtcagggagccatgctgccttgccggttgacgcgatgatcgaagatgtcaagggggctgatgcgtcggtgtcaatgaaatagagccagtagtcctgtactcatttgttagtgttttttacgtcttgtaaagtaagcagagcgcacttctctgatttagtcataccggcatctttatgctactttgtttgaccttgaaccctgcaagttgaactataagaaaaccatcatgggatctcaagccacttcttttgtgcagttacaggccagccagccaatgttttatggtggccaatactgattaagctgttgcaaatagcaatgaaaggagatatgacaccaactatagatgcccagatgggtggcccagcatgacacggcctgagcatggatcgagcacggcagggttggacacgcttagccaatcgtgttgtgtgacgtgtcgttccttcccgcgg

SEQ ID NO: 527 - DNA, 1718 bp, Setaria italica
aacggctgcgtgtgccttcccgggcctttcatcaagtcgtagctgcagacgtcctcgtgcgtgctcctttccagtcagagcggtcactgatgagctccatgatttagctctgcagaatattagttgctcgccagcgagcactactgggcgttagagagaggatcaaacacggcgagggtaccaacagttcaacacaggacgcagattctaaaagcttacggaccccggaagcatcgcagacatggggaatgccgctattccagtcgtatcctcggtggcagtagctgcgacagttgtagtaatgatcgccctcatcagaagatgccgcgtcgtgaggaagaagatgaagaagaaaatcgtgaagaaaatcctggacgagattgagagaaagaaccgcgagcgcgagatgcaggcctgcaacgccttggacgacgtggtgatcgagatcgggccggtggagaagttcctgcacgagatcctcaacgagaagcccatgcgtttcagccccgagcagctggcggcctgcactcggaatttctcatcggagttggggtccggcggcttcggcgtggtctacaagggcgacttgccgaacggccttccggtggccgtcaaggtcctcaaggtgtccatgaacaagaaggtccaggaggggttcatggcggagatcggcaccatcggccggacctaccacgtgcacctcgtccggctctacggtttctgcttcgacagggacaccaaggccctggtctacgagttcttggagaacggatcgctcgagaagtacctctacggcgacgaggaggacacggcggcggcgccgccgaggctggagtggaagacgctgcacggcatcgccgtcggcacggcgaaggggatccggtacctgcacgaggagtgccagcagcggatcgtgcactacgacatcaagccggccaacatcctcctcaccagcgacttcaccccgaaggtggccgacttcgggctggcgcggctgggcgagcgggagaacacgcacatgtcgctgaccggcggcggccgcgggacgcccgggtacgcggcgccggagctgtggatggcgctgccggcgacggagaagtgcgacgtgtacagcttcgggatggtgctgttcgagatcctgggacggcgccggaacttcgaccctgaccatggcgagagcaaggagtggttcccgaggtgggtgtgggagaggtacgagcagggcgagatcaggagcgtcgtgtcctgcgacgggatcgaggaggcggacagggagaaggcggagatgatgtgcaaggtggcgctgtggtgcgtgcagttccagccggcggcgaggccgacgatgagcagcgtggtgcggatgctggagggagagatgcccatcgtcccgccggtgaaccccttccactacttgatggacagcagcggcggcggctcaacaagctcggggctgtggagcggcacgtaccagagcagcagggacaccgccggcagagacagtgaggtgtcatcaatgagccctgctgccaagtcggatgacgcgatgattcaagatgttaagcggactcacgcgtcggtgtcaatgatttagaatttgtcatcttgtacacatttgttaatgtttacatcacgtacaattaggggtgttctgtcatgctggatatttgatattaattagaaatattaaatataatctaattatacgaatctattaaacc

SEQ ID NO: 528 - DNA, 743 bp, Zea mays
acatagagccgcgccgccgcaagagaggagagagcgcctccaacgccacctggaggagaggacagcgcgccagggagggggaggaggaagaagaacatggggaagggcgtcctggaggtgcacctcgtcgacgccaaggggctctccggcaacgatttcttagggaagctggacccctacgtgatcatgcagtaccggagccaggagcgcaagagcagcgtcgcccgagaccaaggaaggaacccgtgctggaacgaggtgttcaagttccagatcaactcggccgcggccaacgtgcagcacaagctcatcctccggatcatggaccacgacaacttctccagcgacgacttcctcggcgaggcgacgatcgacgtgacggacatcgtcagcctgggcgccgagcgcggcacgtaccacctcaacgcggccaagcacaacgtggtcctcgccgacaagacgtaccacggcgagatcaaggtcgccatcaccttcacctccacccagacccaggttcaggaagatggaggagcaattggaggatggaggcacagtagctttaatcagtgaaagtgataggcgtcgtggactctctcaagttctttggttgcttggtggtgtttcgggttggatgtagtttttgtttatgtccacgagcaatctgtgcctaacatttctagggttcaattcaatgattcaatccaaccatatctcgttggaaatcatgtctgtactgaagaccg

SEQ ID NO: 529 - DNA, 753 bp, Zea mays
ccgcactccaatcccaacacagcaaccagcgcaaatcagcacgatgcgtcgcgagggccgccagcacgggtgggtgtttaccgtcgaccccagcctggtcgacgcggagggcaagtgccggtcccgcgcggtgcaggtggagggcgcggcggcggccaacggcggcttcgtcagggcgtcgaggaagcccaccaaccactccaagcccgccgtcggccgcgcgtacaagtccctgatcggcaagggagaggccgggtcgggcaagcagggcaggcacaagttcaagcacgacgaggtcaagatgtactccctctacctcgagggcgcccacgacgcctacgcggatgcgatgctggagttcgactcgtagtcctgctgatgacattgggtgtgtgaatgatgaggtgctggagttcgacatgcgccattgccaggaggtgtagagattcgatgtacgcttctgtgtctgaatccaaatgtgttttgtgatgtgagcagtgaataaacagactggttgtgacgagaatgtcgtgatccggaatgtatctcgaaccggaattcgatcaatcttcatatccaaagttcaaatctgtagagttggaattttatttagccgtgtgagtttccgtttttcggtcctggttattttcaaatgtaatactagcttagtagctttcgtgcagttaaaagacttactttctggcacaaagcgtattgtcattgtcaaacagtatatggcattggatatttaaa

SEQ ID NO: 530 - DNA, 797 bp, Zea mays
cgtaccacactaccacccaccccacgaaaccgtaagaagcgcagagtgtgagagagaggggcatcaaggacgacgtgggcaagatgatgcaggtgttcgtgaagacgctggtggggaagacgatcacgctggaggtggagtgcagcgacaccgtcgagaacgtgaaggccatgatccagggcaaggaaggcatcccgccggaggagcagcgcctcgtcttcgcgggcaagcagctggacgacgacggccgcaccctggccgactacggcgtccagaaggagtcgacgctgcacctggagctgcgcctccgcggcggcagcaggggcggctaccccatggggatcccgcccagcctccgcgagctcgcgcagaagtacaacgagaacaagatggtctgccgcaagtgctatgcgcggcttccgcccagggcaaccaactgccgcaagaaaaagtgtgggcacagtaacgagctgaggtcgaagaaaaggttcatgtccaagattggcgggaaatgatcggcttttgtcattgcgtgacatatatggagcatcagctgaaatttcttagacgcttaataatttttactttaacgccgtggatgtgatattttactgaataaagttgtagtagaaacaaaaaattcgtgctactcttgatcgagatgtttcttcatatacgccctttcgctgtggtttgcttaggctaatcacaatgaaggtttcatgaggtgtttcatgtatttattagcttgacacatcagctatttcgatgacatgtcacatcatttaataaggaag

SEQ ID NO: 531 - DNA, 2947 bp, Sorghum bicolor
gtcgtcggcaccccaagcccccgcacccccagttgcccccgccccgcgccacgcgcccgcgcgccttgaccatgtgacgagcccgtcggcctccacgttccccctgccgcgccacgcagcaacgccttcctcatcatactatatagaaaaaacatataggagtcatggagtagtatttctcatcctctgaccgccgccgccgccgcccaccaccgaagaaaccagcggagcggtgcggtggtgatgatgatgaccaccatccccgctgctcggggcgcggtcgccgcgtgagacgacgaggcagagaccagagagatatatagagagagagagagcagtagcgaaagcgcggagtgggtccgtggactggggcacgagcgccgccggaagaggttgccgggcggctgtagaccctcatcgaccacggcgatggatatcacggaggtgacggtggtacaccacgcggcgctcgtgctggcggcgctctgggccgccgcggctgccggctgggcgcacccagcgctcttcctcgtcgcgctcctctacatatttgcggtgaatcaacggtacacaatgaggttgtggaggcggatacagtatgaggaaaggaaatgtgcgaatcagagaaagcttctctctgatgcagagactgtcaggtggcttaattatgctgtggaaaagatttggccagtttgcatggagagggttgcatcccagcagttccttttgcccatattcccgtggttcctagagaagttcaaaccatggacagcaaggaaagcagtaatccaaagtctttacttgggtaggaacccaccgatgtttacagatattagggttgttaaccaatcaactgatgatgaccacttggttctagagatagggatgaattttctttcagctgatgatatggatgcaagaatggctgtgcaactaaggaagagattaggatttggcattacaacaaacatgcatataactgggatgcatgttgaaggaaaggttctggtaggggtgagatttctgcggcagtggccatttattgggcgtgtaagagtatgctttgttgagcctccatacttccaaatgacagtgaaaccattgtttggtcatgggcttgatgtaactgaactcccaggaatttctggatggcttgacaggatgctggatgttgccttcggacagacacttgtggagcccaacatgctagttattgatctggagaagtttgcctctgaatcaacagagaactggtttagtgttgatgagaagcctcctatcgcatatgctcgagtggagatcctggaaggtgctgatatgaagccatctgatccaaatggactagctgatccatatgtgaaaggacatcttggaccctaccgttttcacacaaagatccataagaaaactcttaatccaaaatggcttgaggagtttaaaataccaataacttcatgggaagcactcaaccttctttctcttcaagtccgagataaggatcccatttttgatgacactcttggtgattgttccataagcatcaacaaattaagaggtggaaaaaggcatgatctatggattgcactgaagaacataaagacagggaagattcacatttctgtaactgtacttgaagaagaaaatgaaaaggttcctaatgatgaagaggaacagtgtggaatacataaggtggacgaagctagcacaccgaggtcaagtttctcctccaggaccaaccatggaagtgaatcttctgatgaattccagaagatgtctgatgaatttgagccagttgacatagaaggatcagaaaagcccgatgtttgggtgcatcgccctggcagtgatgtcaccagtgcatgggaacctcgtaaaggccgtccccggtgccaggattccaaaattcaccgggagaatgatgcttgtagtgatagcccaaggtcatcagcgtcagaatctcatagaagtgactccagcactgaagaagccacgagcagtaaatcgcaccgccacctccacaaggtcaagaagggtctgggcaagctagctggagcagtgctccaccggagcccaaggaaagagaatgacgacgaagcttccccatgtgtaacgcctcacccaaacattcggccggttggggaaagcagggtttcagtaacatatctggtcgatcaagatcctggggtcaacagatcggggtcaagaccagaccagcagcaaagccctgagagagaggagctggacagcccgaataaaaggcacctgaggaagaaggcggtgcacatggtgaaacatgctgggaaaaccgctcataatctaaagagcatgttcagcaagaagggcctcgacaagagcaaagaagaagaacacagtgatgaggaaggcgatgttgttgcgatggaaaaaactggcatggaagttgatccttcactaccaagcatttgatgaccttgcgatgcaaaaggacgggttagaaccatagaagttgatccttctctaccaagtaattgatgctgttgatgcgctagagtctgtggctgatgtcacggacgatgtgaggtaaacgcaatctgcgcgttatatgcaagtgaccttggtatgagcatgtgtagaactgtagtctgtaggtagttactgtaaccccaggtgttaatcaaaggctaatcataggctaggcagtgggttgaacttaaacaagataatgatcatgagctttagttcaaaatcttttaaagtggtgacggaatttctctgaaaataggtcccaacgtgaactttttgaaagacaaaggcaatattgttttgtttatatgttaaccttttcaaaaatacgcttgtgtaatgttaattgtgtcttttcatgtgcatcacctaaacatgaactcatcttgatcatatgagaagttgcatgaagttggaatcacttaatcacattaaatgaattgga

SEQ ID NO: 532 - DNA, 1498 bp, Hordeum vulgare
accatcaccacacaacccaactcctctcactccccaacaatctcaaacaacagctcgaggaatcaacagcagcgactactctgttcgttgaaccaacaatcaacagacggacatggggatgccggcggcgaggaggagggagagggacgcggaggcggagctgaacctgcccccgggattccgcttccaccccaccgacgacgagctggtggagcactacctgtgccgcaaggcggcggggcagcgcctgcccgtgcccatcatcgccgaggtcgacctctaccgcttcgacccgtgggcgctccccgaccgcgccctcttcggcacccgcgagtggtacttcttcacgccccgcgaccgcaagtaccccaacggatcccgccccaaccgcgccgccggcaacggctactggaaggccaccggcgccgacaagcccgtcgcgccccgcgggggtcgcaccatggggatcaagaaggccctcgtgttctacgccggcaaggcgcccaagggggtcaagacggactggatcatgcatgagtaccgcctcgccgacgccggacgcgccgccgccagcaagaagggctccctcaggctggacgactgggtgctctgccggctgtacaacaagaagaacgagtgggagaagatgcagctgcagcagcagcagggggaaggggagaccatgatggagcccaaggcggaggagaacacggcgtccgacatggtcgtcacctcgcactcccactcccagtcccagtcgcactcgcactcgtggggcgaggcgcgcacgcccgagtcggagatcgtcgacaacgacccgtcgctgttccaccaggcgcaggcgacggcgttccagacgcagagccccgcggccgccgcggcgcaccaggagatgatggccacgctgatggtgcccaagaaggaggcggccgatgagggcaggaacgacctgttcgtggacctcagctacgacgacatccagagcatgtacaacggcctcgacatgatgccgcccggggacgacctgctctactcctccttcttcgcctcccccagggtccggggcagccagcccggctccggcggcatgccagccccgttctaagcacacagcaaagacagaccatcagaccgtcagactccgatcgacagaagcggaatggatgacttcttcgccgcgggcgagcgagcgagatcgcggtgcagtgtaaatacagcataggaaacgggagggaggtggccgtcctgtctgagagaagccggcgtggtgagggcggcggcgccggggcgtgttgctgtacatggagagcccggcgccggggcctggccggctgggttgattctttcgttcttactttgtactctcaatgcggatgtagctctcttctcttctcactcctcagtagtagaatgagaatcgaccgaccaaatacatatgtagctctgtttcttccttctcttcagtagaaatcaaccaaattttgctgtttatgctgct

SEQ ID NO: 533 - DNA, 568 bp, Zea mays
acctggaggagaggacagcgcgccagggagggggaggaggaagaagaacatggggaagggcgtcctggaggtgcacctcgtcgacgccaaggggctctccggcaacgatttcttagggaagctggacccctacgtgatcatgcagtaccggagccaggagcgcaagagcagcgtcgcccgagaccaaggaaggaacccgtgctggaacgaggtgttcaagttccagatcaactcggccgcggccaacgtgcagcacaagctcatcctccggatcatggaccacgacaacttctccagcgacgacttcctcggcgaggcgacgatcgacgtgacggacatcgtcagcctgggcgccgagcgcggcacgtaccacctcaacgcggccaagcacaacgtggtcctcgccgacaagacgtaccacggcgagatcaaggtcgccatcaccttcacctccacccagacccaggttcaggaagatggaggagcaattggaggatggaggcacagtagctttaatcagtgaaagtgataggcgtcgtggactctctcaagttctttggttgcttgg

SEQ ID NO: 534 - DNA, 443 bp, Zea mays
actccaatcccaacacagcaaccagcgcaaatcagcacgatgcgtcgcgagggccgccagcacgggtgggtgtttaccgtcgaccccagcctggtcgacgcggagggcaagtgccggtcccgcgcggtgcaggtggagggcgcggcggcggccaacggcggcttcgtcagggcgtcgaggaagcccaccaaccactccaagcccgccgtcggccgcgcgtacaagtccctgatcggcaagggagaggccgggtcgggcaagcagggcaggcacaagttcaagcacgacgaggtcaagatgtactccctctacctcgagggcgcccacgacgcctacgcggatgcgatgctggagttcgactcgtagtcctgctgatgacattgggtgtgtgaatgatgaggtgctggagttcgacatgcgccattgccaggaggtgtagagat

SEQ ID NO: 535 - DNA, 440 bp, Zea mays
gcaagatgatgcaggtgttcgtgaagacgctggtggggaagacgatcacgctggaggtggagtgcagcgacaccgtcgagaacgtgaaggccatgatccagggcaaggaaggcatcccgccggaggagcagcgcctcgtcttcgcgggcaagcagctggacgacgacggccgcaccctggccgactacggcgtccagaaggagtcgacgctgcacctggagctgcgcctccgcggcggcagcaggggcggctaccccatggggatcccgcccagcctccgcgagctcgcgcagaagtacaacgagaacaagatggtctgccgcaagtgctatgcgcggcttccgcccagggcaaccaactgccgcaagaaaaagtgtgggcacagtaacgagctgaggtcgaagaaaaggttcatgtccaagattggcgggaaatgatag

SEQ ID NO: 536 - DNA, 2301 bp, Sorghum bicolor
cagagagatatatagagagagagagagcagtagcgaaagcgcggagtgggtccgtggactggggcacgagcgccgccggaagaggttgccgggcggctgtagaccctcatcgaccacggcgatggatatcacggaggtgacggtggtacaccacgcggcgctcgtgctggcggcgctctgggccgccgcggctgccggctgggcgcacccggcgctcttcctcgtcgcgctcctctacatatttgcggtgaatcaacggtacacaatgaggttgtggaggcggatacagtatgaggaaaggaaatgtgcgaatcagagaaagcttctctctgatgcagagactgtcaggtggcttaattatgctgtggaaaagatttggccagtttgcatggagagggttgcatcccagcagttccttttgcccatattcccgtggttcctagagaagttcaaaccatggacagcaaggaaagcagtaatccaaagtctttacttgggtaggaacccaccgatgtttacagatattagggttgttaaccaatcaactgatgatgaccacttggttctagagatagggatgaattttctttcagctgatgatatggatgcaagaatggctgtgcaactaaggaagagattaggatttggcattacaacaaacatgcatataactgggatgcatgttgaaggaaaggttctggtaggggtgagatttctgcggcagtggccatttattgggcgtgtaagagtatgctttgttgagcctccatacttccaaatgacagtgaaaccattgtttggtcatgggcttgatgtaactgaactcccaggaatttctggatggcttgacaggatgctggatgttgccttcggacagacacttgtggagcccaacatgctagttattgatctggagaagtttgcctctgaatcaacagagaactggtttagtgttgatgagaagcctcctatcgcatatgctcgagtggagatcctggaaggtgctgatatgaagccatctgatccaaatggactagctgatccatatgtgaaaggacatcttggaccctaccgttttcacacaaagatccataagaaaactcttaatccaaaatggcttgaggagtttaaaataccaataacttcatgggaagcactcaaccttctttctcttcaagtccgagataaggatcccatttttgatgacactcttggtgattgttccataagcatcaacaaattaagaggtggaaaaaggcatgatctgtggattgcactgaagaacataaagacagggaagattcacatttctgtaactgtacttgaagaagaaaatgaaaaggttcctaatgatgaagaggaacagtgtggaatacataaggtggacgaagctagcacaccgaggtcaagtttctcctccaggaccaaccatggaagtgaatcttctgatgaattccagaagatgtctgatgaatttgagccagttgacatagaaggatcagaaaagcccgatgtttgggtgcatcgccctggcagtgatgtcaccagtgcatgggaacctcgtaaaggccgtccccggtgccaggattccaaaattcaccgggagaatgatgcttgtagtgatagcccaaggtcatcagcatcagaatctcatagaagtgactccagcactgaagaagccacgggcagtaaatcgcaccgccacctccacaaggtcaagaagggtctgggcaagctagctggagcagtgctccaccggagcccaaggaaagagaatgacgacgaagcttccccatgtgtaacgcctcacccaaacattcggccggttggggaaagcagggtttcagtaacatatctggtcgatcaagatcctggggtcaacagatcggggtcaagaccagaccagcagcaaagccctgagagagaggagctggacagcccgaataaaaggcacctgaggaagaaggcggtgcacatggtgaaacatgctgggaaaaccgctcataatctaaagagcatgttcagcaagaagggcctcgacaagagcaaagaagaagaacacagtgatgaggaaggcgacgttgttgcgatggaaaaaactggcatggaagttgatccttcactaccaagcatttgatgaccttgcgatgcaaaaggacgggttagaaccatagaagttgatccttctctaccaagtaattgatgctgttgatgcgctagagtctgtggctgatgtcacggacgatgtgaggtaaacgcaatctgcgcgttatatgcaagtgaccttggtatgagcatgtg

SEQ ID NO: 537 - DNA, 1001 bp, Hordeum vulgare
cggacatggggatgccggcggcgaggaggagggagagggacgcggaggcggagctgaacctgcccccgggattccgcttccaccccaccgacgacgagctggtggagcactacctgtgccgcaaggcggcggggcagcgcctgcccgtgcccatcatcgccgaggtcgacctctaccgcttcgacccgtgggcgctccccgaccgcgccctcttcggcacccgcgagtggtacttcttcacgccccgcgaccgcaagtaccccaacggatcccgccccaaccgcgccgccggcaacggctactggaaggccaccggcgccgacaagcccgtcgcgccccgcgggggtcgcaccatggggatcaagaaggccctcgtgttctacgccggcaaggcgcccaagggggtcaagacggactggatcatgcatgagtaccgcctcgccgacgccggacgcgccgccgccagcaagaagggctccctcaggctggacgactgggtgctctgccggctgtacaacaagaagaacgagtgggagaagatgcagctgcagcagcagcagggggaaggggagaccatgatggagcccaaggcggaggagaacacggcgtccgacatggtcgtcacctcgcactcccactcccagtcccagtcgcactcgcactcgtggggcgaggcgcgcacgcccgagtcggagatcgtcgacaacgacccgtcgctgttccaccaggcgcaggcgacggcgttccagacgcagagccccgcggccgccgcggcgcaccaggagatgatggccacgctgatggtgcccaagaaggaggcggccgatgagggcaggaacgacctgttcgtggacctcagctacgacgacatccagagcatgtacaacggcctcgacatgatgccgcccggggacgacctgctctactcctccttcttcgcctcccccagggtccggggcagccagcccggctccggcggcatgccagccccgttctaataa

SEQ ID NO: 538 - DNA, 747 bp, Zea mays
ttctgccgcaagacacaggcgacgaaaccgatgtgcggaaggagagcccccggtatccaggaaaaccagcgcccgcggccgcttgtttgcagtcctccctcccgtatatatcaacccgcccaccacacctccaccccaaacaggcaaacacacaacacaaccaaccacctcactcgatctctcatcactcgcaagtccagcgatcaccaaccagagctcggctccaagcctccaacaacccaaggagacagatacgttcgcagatggcgggtgcagcgaaggcgtcgtggatggtggccatgagcgtgggcgccgtggaggcgctcaaggaccagggtggcctctgccgctggaactacgcgctgcggtccgtccaccgcaccgccaaggccaacgtccgcagcagcctcgccgcgcagcgggacaaggagctggccccggcggcggcggcggcggagtcgaagaggcggccgggcaaggccgccgcggaggaggggatgaggaccgtcatgtacctcagctgctggggacccaactaggaggactagctagggttcactgttcagttcattgctggtgctgggttcagttcagacctggctggccggttgcctcctgcgattgtaaaataggaatacggtcacgacgatgaatgatgatgacgatgaaaagttctgccactgtatgtttcaggcctgtgggctcaaaacaagaattcggtggtgcttgatggctgaaacatccata

SEQ ID NO: 539 - DNA, 470 bp, Saccharum officinarum
agagcccccggtatccaggaaaaccagagtcggcgcccacccgtttccgccgcgccgccctggcctcccgccgcccgccccggctcgcctctccacctcaacacagcatcaagcaacctcacttgctacaagcgatcagtgaccgcgctctcgagggagaaggagaagactagaccaggaaggagatggcaggtgcggccaaggcgtcgtggatggtggcgatgagcgtgggcgcggtggaggcgctcaaggaccagacgggcctctgccgctggaactacgcgctgcggtccgtccaccggaccgccaaggccaacgtgcgcagcagcttcgcggcgcaggccaagaagctggccccgccggcggcggagaagaggcgggccgacaaggccgcggaggggatgaggaccgtcatgtacctcagctgctggggacctaactagccatagacacagctggcgtttgtcttg

SEQ ID NO: 540 - DNA, 505 bp, Saccharum officinarum
caagcaacctcacttgctacaagtgatcagcgatcagtgacctctctctcgagggagaaggagaagaccagaccaggaaggagatggcgggtgcggcgaaagcgtcgtggatggtggcgatgagcgtgggcgcggtggaggcgctcaaggaccaggcgggcctctgccgctggaactacgcgctgcggtccatccaccggaccgccaaggccaacgtgcgcagcagcctcgccgcgcaggccatgaatctggcgccgccggcggcggcggcgacggagaagaggcgggcggacaaggcctcggaggaggggatgaggaccgtcatgtacctcagctgctggggacctaactaaccactgttagttgttcgtcttgttcttcttcagcgaccgagctgggtttgagaccttgccggttttgctcaccctgactgtaaatatatgacgatgatcggatgatgatgaaaagttctgccacttaattcgagtgttttctactgtgtccc

SEQ ID NO: 541 - DNA, 517 bp, Saccharum officinarum
ctgattacagcgagaatcaccagtcaaagaagccaagagaaggcaggcgccgagacccgagaagaaagaacaggagatagatggccgctgcagccaaggcgtcgtggatggtggcgatgagcgtcggggcagtggaggcgctcaaggaccaggcgggcctctgccgctggaactacgcgctgcggtccgtccaccgggccgccaaggccaacgtgcgcagcagcctcgtgcaggccaagaagctggcgccggcggagaagaggcgggcggacaaggccgaggaggggatgaggaccgtcatgtaccttagttgctggggccccaactaggcctcggtttggtttcggctttctgcaaccgagctcggcttcagacctggctggttgccttgccgacccattgtaacatagagtacgatgatgatgaaaacttctgcacttgatttcatttcagtgcctgaaactctgaatgcctacgctactgtgctggcatggaaataaaggatgattttcagttc

SEQ ID NO: 542 - DNA, 1072 bp, Sorghum bicolor
cggagggcgcatctttgcgtgggatgattatgcggactagtaggattaaaggcgtgtgttctctctgctttaactcggcgatggcgagccttgtgcgaccgcttcagagctttgacttggacagagcccagccatggcagccggagcgaggcgccgataaatacgcgcgcccgcgcccggtcacgcatcttagctaagccttgtcccttgttagttacagccggtagagtattgactagagcgggaggaaagagcatctccaatccaacgccggcgccgagggagaaggaaaggaggggaacgatcggaacgagcatggggaagggcgtcctggaagtgcacctcgtcgacgccaagggcctctccggcagcgatttcttagggaagctggacccctacgtgatcgtgcagtaccggagccaggagcgcaagagcagcgtcgcccgagaccaagggaggaacccgtgctggaacgaggtgttcaagttccagatcaactccgccgcggccaacgcgcagcacaagctcatcctccgcatcatggaccacgacaacttctccagcgacgacttcctcggcgaggcgacgatcgacgtgacggacatcgtcggcctgggcacggagcgcggcacgtaccacctcaacgcggccaagcacaacgtggtgctccccgacaagacgtaccacggcgagatcaaggtcggcatcaccttcaccgccacgcaggttcaggaagatggaggagccattggaggatggaggcacagtagctttaatcagtgaaaggcggcgaaggccgtggtgatgaactctcaaaagttctttggttgctactagcttggtagtgttttagttgaatgtatagttttgtttatctccacgagcacatctgtaattctgtattgaagagtggttaaaacggtcagatccgtatgacttttaagacaccatgaatttagcaattgttgatagacagactcttcttttgtggagcatactatgtaagtatatatcgtcattcgtcttatgaaggatgcgtgaagtaaggctagcagctgacagctgtgctccc

SEQ ID NO: 543 - DNA, 757 bp, Setaria italica
cgcctgcaggtatctgtaggtagccttcgttagcaccggaaggaaggaggactcagcggccgccgccccccgactccccaatctcgagaggaaggagagaccccgggcttgggctcgtgccgagcggaggaggcgaaggacgatggggaagggcgtcctggaggtgcacctcgtcgacgccaagggcctttacggcaacgatttcttagggaagctggaccccttcgtgatcgtgcagtaccggagccaggagcgcaagagcagcgtcgcccgagaccaggggaggaacccgcgctggaacgaggtgttcaagttccagatcaactcggccgcgtccaacgcgcagcacaagctcatcctccggatcctggaccacgaccatttttccagcgacgactcgctcggggaagcgacgatcgacgtgacgggcatcatcagcctgggcgcggagcgcggcacgtacacccagagcgcggcgaagcacagcgtcgtcctcgccgacaacacgttccacggcgagatcaaggtcggcttcaccttcaccgccacccaggttcaggaagatggagaggaaatcggaggctggaggtacagcagctttaatcagtaggcgtggtgacctctgaagttctttagttggttggtttgtagtgattcgggttgggtgtagcttttgtttatacttagcccctactcctgggtccccacttcctgagtagggggctctaattttgtgttcaacttcagcagtagcccc

SEQ ID NO: 544 - DNA, 1030 bp, Panicum virgatum
gccattacggccggggatctgtagccttcgccagcgccggaagttaaagaacaaagaagaggacgccccggccgcaactcccctagacgaagaagagacccttgggctgacgtcgagcggagaaggcgagagaagatggggaagggcgtcctggaggtgcacctcgtcgacgccaggggcctctccggcagcgatttcctagggaagatcgacccctacgtgatcgtgcagtaccggagtcaggagcgcaagagcagcgtcgcccgagaccaggggaggaacccgtgctggaacgaggtgttcaagttccagatcaactcttcggcgtccagcgcgcagcacaagctcatcctccggatcatggaccacgaccacttctccagcgacgacttcctcggcaaggctacgatcgacgtgacggacatcatcagcttgggcgcggagcgcggctcgtaccacctcaacgcggggaagcacaacgtggtcctcgccgacagcacgtaccacggcgagatcaaggtcggcatcaccttcaccgccgcccaggttgaggaagatgatgaggattttggaggctggaggcgcagaagctccaatgcgtaggtgcggtgaaatctgaagaagttctttggttggtttgtagtgtagtaattcaggtcgggtgtagtttttgtcgtttgtactggcagaagtttgtgcccaagattgttgattggctggttagactatgtgtaatcaagtatgcttaaagccgttgttgattgacaaattctttctttttgtgtactgtgtttgattggttcgatgggggtgaagggtgatggacccaactgttagttttgggtgatcagttaaccaccacccaacctctgaattttcccgtgattttcgatttgtccgcgctgctcacgccgcaggtgtgccccgtgccgcgcgcgcggccgttccatctcggacaaatagatccaccagcgccgttcggaccgagcatcacgcttcgcgcgcctcggccagctgtagctgctgcccg

SEQ ID NO: 545 - DNA, 922 bp, Panicum virgatum
cggcgaccgcttccgagctctgacctggactcagccagccaacgcagcgggagcgaggcgcgccggcagataaatacgctcgcacgccaccggtcaggtatctgtagccttcgccaatcgccagcgccggaagggaaagaagaggacgtcgcggccgcaactcccccacagaggaagaagaagagaccctgctagcgaggatggggaagggcgtcctggaggtgcacctcgtcgacgctaggggcctctccggcaccgatttcctagcagggaagatcgacccctacgtgatcgtgcagtatcggagccaggagtgcaagagcagcgtcgcccgagatcaggggaggaacccgtgctggaacgaggtgttcaagttccagatcaactcttcggcgtccagcgcgcagcacaagctcatcctccggatcatggaccacgaccacttctccagcgacgacttcctcggggaggcgacgatcgacgtgacggacatcatcagcctgggcgcggagcacggctcgtaccacctcaacgcggcgaagcacagcgtcgtcctcgccgacagcacgtaccacggcgagatcaaggtcggcatcaccttcaccgccgccaaggttgaggaagatgatgaggattttggaggctggaagcacagaaacttcaatgagtaggtgctgtgaactctgaagttctttggttggtttgtagtatagtaattcaggttgggtgtagttcgcattatcattggcttgttaactatgtgtaatcaagtgtgcttaaagccgttgttgattgaccgattctttctttttgtgtactgcatttgattgattcgatgggggtgatggaccaactggcaactgttagttttgggtgatcagttaaccaccacccaacctctcaattttcccgtgattttcga

SEQ ID NO: 546 - DNA, 4121 bp, Oryza sativa
cactgaacatcaacatataagaaaacaagcccaaacacatcccttgtcagtccaaagtccaaattcaaccatggtacgtcggtgtccatttggccaattccaattccaattcctcggctgcgcgttgaattacaggtccaactatttcggccacctctactgtctctctcccatcctctccgcccccaaatgggcaacaaaataaaaaaccccaacccgcgatccggcgaatcggcgtcgatgcttagccggggaggtaaacccccgacgcaacaattccacacctaccgcggctaccgagccaccggccaacccctccccctccctccaaaacccgcacgcgcggatcccgtcgcgagagccgaaatcacacgtcgccaccgcagcagcagccgcggcgcgccacgcggccgcggcggaccccgcccgcccgccacgtcccccgcgccgccgaccactccggcacgtagtaggccgtgagacatccaccatatcttccccgcctcggcgcgcgcgtactcctacgtctacgtgcgtgagccccccacacaccctcgctcgccgcgccgccgtctctagttttttttttctaaaaaaaaaaaagcctcggccgccgcagccgcccctgcccatcgatcgcggcttgtctcttccccttccctctgcctggcgtggagtactactgcgctactagagagtttgctggtggaggaggaggacgaggaggaggaggctgggtggtggcggccgccgcgatggacataacggaggtgacggtggtgcaccacgcggcgctggtgctgctcgcgctctgggccgccgtgtcggccgggtgggcgcacccggcgatcttcctcgccgcgctcctctatctgttcgcggtgaatgaacgatacacaatgaggctgcgaaagcgaatacaacatgaggaaaggaaatgtgcaaaccaaagaaggcttctctctgatgcagagactgtcaggtggttgaattatgctgttgagaagatctggccggtttgcatggaacgggttgcatctgagcagttccttttgcccatattcccatggttcctggaaaagttcaaaccatggacagcgaggaaagcagtgatccaagacctttacttgggcaggaacccaccaatgtttacagatattagggttgtcaggcaatcaactgatgatgaccatctggttttagagataggaatgaacttcctatctgcagatgatatgaatgcaacaatggctgtgcaacttaggaagagattaggatttggcatcacagcaaacatgcatataactgggatgcatgttgaagggaaggtcctagttggggtgcgatttctccgacagtggccatatattggtcgcgtaagagtgtgctttgttgagcctccatacttccagatgacagtcaaaccattatttggtcatgggcttgatgtaactgaacttccaggaatttctggatggcttgacaggatgttggatgtcgcctttggacagacccttgttgagcctaatatgctagttattgacttggaaaagtttgcatcggaatcaacagatagctggtttagtgttgatgagaagccacctattgcacatgccaaggtagagatcttggaaggtgctgatatgaaaccctctgatccaaatggattagctgatccatacgtgaaaggccatcttggaccctatcgtttccagacaaagatccacaagaaaacactcaatccaaaatggatggaggagttcaaaataccagtaacctcatgggcagctctcaatcttctctctcttcaagttcgagataaggatcccatctttgacgacacactcggtgactgttccataagcatcaacaaattgagaggtggacaaaggcacgacatatggattgctctgaagaatataaagacagggcggattcatatagcagtaacagtacttgaagatgaaaatgaaaaggttccaaacgatgacgatgagcagtgtggaacacccaaggggggtaaagcaagcacaccaaggtctagcttttcgtccaggaccaacaatgaaagtgaatcatcagaggagtttcgaaagatatctgctgaatatgagccagtagacattgaaggactggaaaaggttgatgtttgggtccatcggccaggcagtgatgtcgcagtcacttgggagcctcggaaaggacgtgcgaggtgtcaggattccagaatcctacgagagaatgatgtctactgtgacagccctaagtcgtgccaatcagaatctcagagaagtgactccagtactgaagaaccagccaatggcaaatcacgccatcatctccacaaggtcaaaaagggtttggggaaactagctggtgcgatgttcaagagcccaaagaaagagagtgatgatgaagcctcgccatgtgtgacgcctcacccaaatataaaaccacttggagaaaaaagggtgtcagtaagatacgtcgtcgatgaagatccttctgaaaacttgccagatgaccagcattccagtcctgagagaggcgagtcggaaagtccgaccaagaggcatttgaggaagaaggctgtgcacatggtgaaacatgcggggaacaaaacagctcataatctgaagaacatgttcagcaggaaaggcagtgacaagagcaaagaaggccaagatgaccagaaagacgatcctgatactatagtagtagaaccttcaaaagttaagaaagacaatcctgatgcaagtgaggtagacatagacccttcacaagttgagaacgacatccccgattcaacggcaattgaccctttgaaggttgattctaatgtggccaacaacattgtggttgatgcactagagtatgcatctgaatctgatgcgaaggacaaaccacagtgaaatgtgttctgctatttttggcggtcctcgtgctgttgggactgttcatgtaggcaggatactaggtagcaaaatagtctgatagcctcctgacagcaagcgaaggttgacagtatagtccgtttggttggttgagtcctccatcttacctgacgaccgatgtttttcttgtattatagatgctcaaggaacaatacctctgtacatgtcgtatgcagactgtctaagctgtttgcttcttggacatggaaagcaggtggccggttggctttggcaaggtgttggataggagagaacggacaaggagaaccaaaaaaaaaaaaaagagattgaaccaagcctattatgtgaccatgcaaaagtagggaacatgcccatccccatccatatactcctttgataatacaaaagtaggagtactagttttgtatagaataatagaattagcctacttgctttagatgtagtctttcagcgtacagtatgtcagtactacagttacatccctaaagttgcgtactttgggaacaatacatcaaaataccaaagtatgggacatccctaaagttctgtttttttttcaacattccgtgtataaaatgaaccatcaagtacatttgtttacttaaacaccatgggaatggggaagattaacttgccacctgatcaatattttcagaaatacctctcatctctggttaattgcattctggttcaggcaatcgagagtgggtgtcctaatccactccactcgcctcccagtcatgagggcgatgcggtcagcgtcaatccacccggaggcggtgcaagccgtcgaggccgccacgtctggtgccggaggaggtggagcggcgccgatggcagggcagatcccgtggcagatctagatgtgaccatggatagcagtgaccaaggatgggcaaagccacgacaaaatccaatggctgcagtagcgtcggtgacttcccgtgcggcggtagtggatgttcctgatgtgttcaatattgtagtgttcttggatgtacttggtggtcttggacaccgattaatactgatgaaatttggtaagtgaaggggagttgctcgatgcaccggctcaagccagctttttttttcctttttttttgttatttgtaggtttttaaactgacacatttgagacctcactacatgtcggttggaaaattcagcacctatgaccggttccca

SEQ ID NO: 547 - DNA, 1810 bp, Panicum virgatum
gtcctcctcttgctccttcccagtcagagcggtcactggatgagctcaatgatttagcccttcaggctgctagcaggtaccagccagagagcacctctcggcgttggaaagaggatcagacacggcgggcgagggtgtcaacagttcaacacaggttccttttcttcttcatgtagtttctttctttgttcgaaagctcttctcgatccggctagcaagttaagttcgttcttcgaaatttcttcagtcatcttataggatggttttgggagtttgcagttggacatgagtaacttgtttcatgcctgagcttcttctatagttcagtaattactgatggagatggagtgatcattgctctgatcgattcagaaacagattttggatttcttttccctttgtttggagttagactacgaaggaaaaaaaaatgtttttgttgggattgcagcttcatttctggttttccccgaactgttctttcacctaacttgattatgtgacgcatgccatgacgctggactgcaaacaaacttgcaacccggaagcaccgcaaacatggggaatgccgctgttgcaatcatttcctcaatcgccggaactgcgacggtagtagtagtgatcgccctcatcagaagatgccgggtcgtgaggaagaagatgaagaagaagatcgggaagaaaatcattaaggagattgagagaatgaaccgcgaggctcaagcctgcaaggccctggaggacgtggtgatcgagatcgggccggtggagaagttcctgaacgacatcctcaacgagaagcccatgcgtttcagctccgagcagctggcggcctgcacccggaactactcgtcggagctggggtccggcggcttcggagtggtgtacaagggcgacctgccgaacggccttccggtggccgtgaaggtcctgaaggtgtccatgaacaagaaggtccaggaggcgttcatggcggagatcggcaccatcggccggacgtaccacgtgcatctcgtccggctctacggcttctgcttcgacagggacaccaaggcgcttgtctacgagttcctggagaagggctccctcgaaaagtacctctacggcggcgacgaggagggcacggcgccgaggctggagtggaggacgctgcacagcatcgccgtcggcacggcgaaggggatccggtaccttcacgaggagtgccagcagcggatcgtgcactacgacatcaagccggccaacatcctcctcaccggcgacttcaccccgaaggtggccgacttcgggctggcgcggctcggcgagcgggagaacacgcacatgtcgctgaccggcggcgggcgcgggacgcccgggtacgcggcgccggagctgtggatggcgctgccggcgacggagaagtgcgacgtgtacagcttcgggatggtgctgttcgagatcctggggcggcggcggaacttcgacccctgcgagggcgagagcaaggagtggtacccgaggtgggtgtgggagaagtacgagcagggcgagctggagtgcgtcgtgtccggtgacggcatcggggaggcggacagggacaaggcggagatgatgtgcaaggtggcgctgtggtgcgtgcagttccagccggcggcgcgcccgacgatgagcagcgtggtgcggatgctggagggggagatggccatcgttccgccggtgaaccccttccactacgtgatggacagtagcagcggctccacgagctcggggctgtggagcagcggcacgtaccagagcagcagggacaccaccggcagaaacagccaga

SEQ ID NO: 548 - DNA, 1603 bp, Zea mays
ataagtcgtagctgcaaacgccatctttctccatcaccattcaccactgaatcagctagactgctctctcatcagctcaacgatttaggcatttagccctgcgggcagcagttgcgagcaaaggccaaagaacacggagaggctaaggctatccacacccacacagagtctaatcaagcttacagcccggaagcgtcacagacatggggaacgcagcagttgcaatcatatcttcagtctcggcaactgcgacggtagtagtaatgatcgccctcatcagaaggtgccgcgtcgtgaggaagaagataaagaagaaaatcgtaaagaaagtcttggaggagatcgagcggaagaaccgcgtgggggcagcctgcgacgccttggaagacgtggtgatcgagatcggtcccgtggagaagttcctcaacgagatcctgaacgagaagccgatgcgtttcagctccgagcagctggcggcctgcaccaagaactactcgtcggagctggggtccggcggctacggcgtggtctacaagggtgagctgcccaacggcctgctggtggccgtgaaggtgctcaaggtgtccatgaacaagaaggtgcaggaggcgttcatggcggagatcggcaccatcgggcggacgtaccacgtgcacctcgtccgcctctacggcttctgcttcgacgcggacaccaaggcgctggtgtacgagttcctggagaaggggtcgctcgagaagtacctctactgtgacgagggcagcacggccacgcggctggagtgggcaacgctgcacggcatcgccgtcggcacggcgaaggggatcaggtacctgcacgaggagtgccagcagcggatcgtgcactacgacatcaagccggccaacatcctgctcacggccgactacaccccgaaggtggccgacttcgggctggcacggctgggcgagcgcgagaacacgcacatgtcactgaccggcggcggccgtgggacgcccgggtacgcggcgccggagctgtggatggcgctgccggcttcggagaagtgcgacgtgtacagctttggaatggtgttgttcgagatcctagggcggcgccggaactacgacccctgccagggcgagagcaaggagtggttcccgagatgggtctgggagaggtacgcgcagggtgagatcgaggacgtcgtggcctgcgacgggatcgttggagacgcggacagagagaaggcggagatgatgtgcaaggtggcgctgtggtgcgtgcagttccagccgtcggcgcgaccgacgatgagcagcgtggtgcggatgctggagggggagatggccatcgtcccgcccgtgaaccccttccactacgtcatggaaagcagcagtgcctcgactagctcggggttgtggagcggcacataccagagcagcagagacaccactgccagagaaagtgagctgtcggctagcccagctgccaagtcgactgacgccatgattgaagatgttgagcgggcttatgcgtcagtgttggcgaaacagagcttgtagtcttgtacacattaattattgagtaaaatgcatccgcgacggtgggataattgactttc

SEQ ID NO: 549 - DNA, 1671 bp, Zea mays
gtcaagaccaatatacatatactccaacagctgcctacgttctccagctccaccatccaggcggtctctcgtgacctcaacaatttaacccagcgggcagcgcagttgacgctcgccagcgagcacagaggacgttagaaagaggatcgaacacggtgagagtatctagttatccacagagattccaatcaagcttacggcccgggaagcgtcgtagacatggggaatgcactcgcaatcataaccacaatcatcgtgagcaagaggatgaagaagaaaatcgtaaaaaaggtcttggaggagatcgaaaaaaagaaccgcgagacgcaagccagcaacaacgccgtggaagatgcggtgatcgaggtcgggcctgtcgagacgttcctgaatcagatcctgaacgagaagccgatgcgtttcagctccgagcaactggcggcctgcacccggaactactcgtcggagctgggatccggcggctacggcacggtctacaagggtgagctcccgaacggcctgctggtggccgtgaaggtgctcaaggtgtccatgaacaagaaggtgcaggaggcgttcatggcggagatcggcactataggccggacgtaccacgtgcacctcgtccgcctctacggcttctgcttcgacgcgaacaccaaggcactagtctacgagtatttggagaaggggtcgctggagaagtacctttactacggcgacgtggagtgcagcacgagcacgggcaaaaggcttgagtggggaacgctgcacggcatcgccgtcggcacggcgaaggggatcaggtacctgcacgaggagtgccagcagcggatcgtgcactacgacatcaagccggccaacatcctgctcacggccgatgacaccccgaaggtggccgacttcgggctggcacgactgggcgagcgcgaggacacgcacatgtcgctgaccggcggcggccgcgggacgcccgggtacgcggcgccggagctgtggatggcgctgccggcgtcggagaagtgcgacgtgtacagcttcgggatggtgctgttcgagatcctggggcagcgcaggaactacgacccctgccggggcgagagcagagagtggttcccgagatgggtgtgggagaggtacgagcagggtgagattgagtacgtcgtgtcgtgcgatgggatcggggaggcggacatggagaaggcagagatcatgtgcaaggtggcgctgtggtgcgtgcagttccagccggcggcgcggccgacgatgagcagcgtggtgcggatgctggagggggagatgccgattgtcccgcctgtgaacccattccactacgtcatggacagcagcagtggctcaactagctcggggctgtggagtgacacataccaaagtagcagagagaccattggcattgccatagacagtgagctatcggttagccctattgccaagtcgacttgattgtaagatgatgatcggactcatatgttgatgttgatgaaatcctgtactgtttgcttattataaacaaaaaaaggctgaggtttgtaaattagcatcatgcataagaatcaaagatatgcgagttgagtggattagtgtggtgtggcacatgtaggctatccctggctaataagctaagtaccgaaagatagagggcttgtttga

SEQ ID NO: 550 - DNA, 2648 bp, Sorghum bicolor
gaattgacgagacgaatcttttgagcctagttagtctatgattggacaatatttgtcaaatacaaacgaaaaagctacagtgtagattttgcaaaatattttggaactaaacaaggcctaggaaggtctacaaattacgaacgaagtggctctaaagcattttcataggtgtggaaccgttttagaaggagcagagccaaagcgccagataagaggatctcggactttttcaaaccagacaacaacattgacatcagagccatatataaaatgctcaaggctaagggccaaacctcagaccccaaggcagtcttcatcgggaaaacttgggcaccccctcgagttcaactgttcatatggctactgctgcaaagaagaatccaatgcagagcggtgttgctcacgaagcacattgtggactcagcaacctgtgaaatctgcaatgccgcggtcgaaactccggagcacatcatccacggctactcgcttggaaggaaagtctcgaggagactcaacctacagtccatgatctcaatggacatgggtcaactgcacacactcacaagctccacatccgtcgtgatccctggactcccctctttcattgcgttggtctgctggcaggtttggaaggcccgaaacgcgaaggtctttagaaatgaagaccacactgttgatcgtgtcctaatggactgcaaagcggccgctgactataacagtaccggataccaagagcgaagagacaaacagcaacacagtggtgcaccatcctacagatggcaacacaggaacgcctcccccgtcgaccgtcaaaaaaaaaaagtggctctaaagtttcgtgatactagagtttcttatagccgaattatgcaaacatgaccttaacgtcttaattagtcagcaacggctgcgtgtgcctgcccgtctcctactctcctgctcctccggtcagagcggtctctcatgacctcaactatatatttagcccgccagcgggcagcgtagcagttgctcgccagcgagcgcagggcgttagaaagaggatcgaactcggtgagggtatccatacagtaatacagactctaatcaagcttacggccccggaagcgtcatagacatagacatggggaacgcagttgcaatcatatctacaattgtcgtgaacaagaagatgaagaagaaaattgtagagaaagtcttggaggagatgaaaaagaaccgcgagatgcaagtcagcaacaacgtggaagatgtggtgatcgaggtcgggccagttgagacgttcctcaaccagatcctcaacgagaagccgatgcgtttcagctcccaacagctagcggcctgcacccggaactactcgtcggagctgggatccggcggctacggcgttgtctacaagggtgagctgccgaacggcctgccggtggccgtgaaggtcctgaaggtgtccatgaacaagagggttcaagaggcgttcatggcggagatcggcactataggccggacgtaccacgtgcacctcgtccgcctctacggcttctgcttcgacgcgaacacgaaggcattagtctacgagtacttggagaatggctcgctcgagaagtatctttacggcgatgtggagggcagcacagccacgaggctggagtgggaggcgctgcacggcatcgccgtcggcacggcgaaggggatcaggtacctgcacgaggagtgccagcagcggatcgtccactacgacatcaagccggccaacatcctcctcaccgccgattacaccccgaaggtgaccgacttcgggctggcgcggctgggcgagcgcgagaacacgcacatgtcgctgaccggcggcggccgcgggacgcccgggtacgcggcgccggagctgtggttggcgctgccggcgtcggagaagtgcgacgtgtacagctttggaatggttttgttcgagatcctggggcggcgccggaactttgacccctgccacggcgagagcaaagagtggttcccgagatgggtgtgggagaagtacgaacagggagagatcgactgcgtcgtgtcctgcgacggggtcgtcggagaggcggacaggcagaaggcggagatgatgtgcaaagtagcgttgtggtgcgtgcaattccagccggcagcgaggccgacgatgagcagcgtggtgcggatgctggagggcgagatggccatcgtcccgcctgcgaacccattccactacgtcatggacaacaacattggctcaactaactcggggttctggagtgacacataccaaagtagcagagagacttggcagagacagcgagctatcggtaattagggctgttgtcaagtcgacttgatcgtcggtgtttatgaaatgaagcttaaagtcttgtactgtttttttacttattatattaaaaacaataaaggctgaggtttgtaaattaacatcatgcattggaggactaaaaaaataaagatactccctccgtccctgaaagctataacttctagagttgttctaagtcaaacttttaaaactttgaccaaatttatagaaaaaaactaagatttatagtaccaaattaataccattagatttatcattgaatatattttcataagatactcattttatgttatacatattgata

SEQ ID NO: 551 - DNA, 1702 bp, Sorghum bicolor
ataaatttgtcaacaatactgtcattatcagccaaacaaagtcatcagctagaccggtctctcatcagctcagtaatttagccctgccactgcgggcagcagctgaccgccagcgagcaaaggccgcgaacacggagtggctaaggctatccacacagattctaaacaaacttacagcccggaagcgtcgcagagacatggggaatgcagcagttgcaatcgcatcttcagtcgggggaactgcgacagtagtagtaatgatcgtcctcatcagaagatgccgcgccgtcaggaagaagataaagaagaaaatcgtaaagaaagtcttggaggagcttgaccgcaagaatcgcgagctgcagctggcctgcgaccccgcggaagatgtggtgatcgagatcggccccgtggagaagttcctcaacgagatcctcagcgagaagccgatgcgtttcagctccgagcagctggcggtctacaccaagaactactcgtgcgaacttgggtccggcggctacggcgtggtgtacaagggtgagctcccgaacggcctgttggtcgccgcgaaggtcctcaaggtgtccatgaacaggaaggtgcaggaggcgttcatggcggagatcggcaccatcggccggacgtaccacgtccacctcgtccggctctatggcttctgcttcgacgcgaacacgaaggcactagtctacgagtacttggagaacggctcgctcgagaagtatctttacggcgacgagggctgcacgaccacgcggctggagtgggggacgctgcacagcatcgccgtcggcacggcgaaggggatcaggtacctgcacgaagagtgccagcagcggatcgtgcactacgacatcaagccggccaacatcctcctcaccgccgactacaccccgaaggtggccgactttgggttagcacggctgggcgagcgcgagaacacgcacatgtcgctgaccggcggcggccgtgggacgcccgggtacgcggcgccggagctgtggatggcgctgccggcgtcggagaagtgcgacgtgtacagcttcgggatggtgctgttcgagatcctggggcggcggcggaactacgacccatgccggggcgagagcaaggagtggttcccgaggtgggcgtgggagaagtacgagcagggggagatcgaggacgtcgtgtgctgcgacgggatcgtcggagaggcggacagaaacaaggcggagatgatgtgcaaggtggcgttgtggtgcgtgcagtttcagccgtcggcgaggccgacgatgagcagcgtggtgcggatgctggagggggagatggccattgtcccgcccgtgaaccccttccactacatcatggacatcagtagtggctcaaccagctcgggaatgtggagcggcacataccagagcagcagagacaccactgctagagatagtgagctgtcgattattagctctgctgccaagtcgactggcgccatggttgaagatgttgagcggactcttgcgtcagtgttgaggaaacaaagcttgtagtcttgtacacattagttaatgtttttactcactagagttactgtaaacagtgaaggttgaggtttgtaaattaggattatgcattggaggactataaagatatacgtgggttcagtgaattgtaccgctacgagtgcgacatagttaggctatcccta

SEQ ID NO: 552 - DNA, 792 bp, Sorghum bicolor
gcacacaatccccacacagcaaccaaggcaaaccagcacgatgcgtcgcgagggccggcagcacgggtgggtgttcaccgtcgaccccagcctggtcgacgcggagggcaagcagtgccgttcccgcgcggtgcaggtcgacggcgcggcggcggccaacggcgggttcgtcagggcgccgcggaagcccaccaaccacaccaagcccgccgtcggccgcgcctacaaggcgctgatcggcaagggagaggctgggtccggcaggggcaggcacaagttcaagcacgacgaggccaagatgtaccacctctacctcgagggcgccgacgacgcctacgcggatgcgatgctggagttcgactggtagtcctactgacatgggtgtgtgaatgcggtgctggatcggagttcgacgggcctcattgccaggaagtgcagagatcgatgttaggcttctgtgtctcaatccaaatgtgttttgtgatgtgagtcgttgttgcgtcagcagtgaataaaaaaaggcagggatctggaatgtatcccaaattgggaatcaatcttgatctccaaagttgaaatttgtaaaagttttagccgtacgagtttccgtttttgggtcctgttgttttcaaatgtaatagcgttcatgcagttaaagactgtttactgttattttctgtcacaaagcgtattgtcaaacaatatcctcgatttcaagaccacgtatcctcggacatcaacaaaaatacatacactacggatccggatcctcagatgtaagcctctgcctaa

SEQ ID NO: 553 - DNA, 1409 bp, Secale cereale
caacagcccgaggattcatctactgcaacatcaccggagcgatttcatcaactactactctcttccaactttcaaagcaaaggatatcatggggatgccggccgtgaggaggagggagcgggacgcggaggcggagctcaacctgccgccgggcttccgcttccaccccaccgacgacgagctggtggagcactacctgtgccgcaaggccgccgggcagcgcctgcccgtgcccatcatcgccgaggtcgacctctaccgcttcgacccctgggcgctccccgaccgcgccctcttcggcacccgcgagtggtacttcttcaccccgcgcgaccgcaagtaccccaacggctcccgccccaaccgcgccgccggcaacggctactggaaggccaccggcgccgacaagcccgtcgcgccccgcggggggcggaccatgggcatcaagaaggccctcgtgttctacgccgggaaggcgcccaagggggtcaagaccgactggatcatgcacgagtaccgcctcgccgacgccggccgcgccgccgccagcaagaagggctcgctcaggctggacgactgggtgctctgccgcctctacaacaagaagaacgagtgggagaagatgcagctgcagcagcaggggggagaggagacgacgatgatggagcccaaggaggagaacacggcgtccgacatggtcgtcacctcgcactcccactcgcagtcccagtcgcactcgcactcgtggggcgaggcgcgcacgccggagtcggagatcgtggacaacgacccgtccctgttccagcaggcggcggcgttccagacccagagccccgcggccgccgcggcgcaccaggagatgatggccacgctcatggtgcccaagaaggaggcggcggacgaggccggcaggaacgacctgttcgtggacctcagctacgacgacatccagagcatgtacaacgggctcgacatgatgccgcccggggacgacctgctatactcctccctcttcgcctcccccagggtgagggggagccagcccggcgccggcggcatgccggccccgttctaagcagagcaaagacagagactgtcagagacctgagatcgacagagaaggagaacggatgacttcctcgccgcgagcgagatcgcggaccagtgtaaatacggaataggaaacgggagggaggtcgcgtcgtgtctgagagaagccggcgtggtgcgggcgccggcgccgtggcgtgccgttgtacatggagagcccggtgccggagcctggccggctgggttgattcttttgttcttgctttgtactctcaatgcggatgtagctctttcttctcactcctcagtagtagaatcgaccaaatacatatgtagctctgtttcttcagtagaatcaa

SEQ ID NO: 554 - DNA, 1413 bp, Secale cereale
cactcaccacatctcaacagcccgaggattcatctactgcaacatcaccggagcgatttcatcaactactactctcttccaactttcaaagcaaaggatatcatggggatgccggccgtgaggaggagggagcgggacgcggaggcggagctcaacctgccgccgggcttccgcttccaccccaccgacgacgagctggtggagcactacctgtgccgcaaggcggccgggcagcgcctgcccgtgcccatcatcgccgaggtcgacctctaccgcttcgacccctgggcgctccccgaccgcgccctcttcggcacccgcgagtggtacttcttcaccccccgcgaccgcaagtaccccaacggctcccgccccaaccgcgcagccggcaacggctactggaaggccaccggcgccgacaagcccgtcgcgccccgcggagggcgcaccatggggatcaagaaggcgctggtgttttacgccggcaaggcgcccaagggggtcaagaccgactggatcatgcatgagtaccgcctcgccgacgccggccgcgccgccgccagcaagaagggctcgctcaggctggacgactgggtgctctgccgcctctacaacaagaagaacgagtgggagaagatgcagctgcagcagcaggggggagaggagacgacgatgatggagcccaaggaggagaacacggcgtccgacatggtcgtcacctcgcactcccactcgcagtcccagtcgcactcgcactcgtggggcgaggcgcgcacgccggagtcggagatcgtggacaacgacccgtccctgttccagcaggcggcggcgttccagacccagagccccgcggccgcggcggcgcaccaggagatgatggcgaccctgatggtgcccaagaaggaggcggcggacgaggccggcaggaacgacctgttcgtggacctcagctacgacgacatccagagcatgtacaacgggctcgacatgatgccgcccggggacgacctcctctactcctccctcttcgcctcccccagggtgagggggggccagcccggcgccggcggcatgccggccccgttctaagcagagccaagacagagaccgtcagagaccgagatcgacagaagcggaatggacgacttcttcgccgcgggcgagatcgcggaccagtgtaaatacggaataggaaacgggagggaggtcgcgtcgtgtctgagagaagccggcgtggtgcgggcgccggcgccgtggcgtgccgttgtacatggagagcccggtgccggggccggggcctggccggctggggttgattcttttgttcttactttgtactctcaaaatgcggatgtagctctttcttctcactcctcggtagtagaatcgaccaaatacatatgtagctctgtt

SEQ ID NO: 555 - DNA, 1643 bp, Triticum aestivum
cagccatcggaatcaacagcagcagcagcggagcgatctcatcgaccaactctcttccaagtttcgattcaacggacatggggatgccggcggtgaggaggagggagagggacgcggaggcggagctcaacctgccccccggcttccgcttccaccccaccgacgacgagctcgtggagcactacctgtgccgcaaggcggccgggcagcgcctcccggtccccatcatcgccgaggtcgacctctaccgcttcgacccgtgggcgctccccgaccgcgccctcttcggcacccgcgagtggtacttcttcaccccgcgcgaccgcaagtaccccaacggctcccgccccaaccgcgccgccggcaacggctactggaaggccaccggcgccgacaagcccgtcgcgccccgcggtgggcggaccatggggatcaagaaggccctggtgttttacgccggcaaggcgcctaagggggttaagaccgactggatcatgcatgagtaccgcctcgccgacgccggccgcgccgccgccagcaagaagggctcgctcaggctggacgactgggtgctctgccggctctacaacaagaagaacgagtgggagaagatgcagctccagcagcaggggggagaggagatgatggtggagcccaaggcggagaacacggcgtccgacatggtggtcacctcgcactcccactcgcagtcccagtcgcactcgcactcgtggggcgaggcgcgcacgccggagtcggagatcgtcgacaacgacccgtcgctgttccagcaggcggcggcgttccaggcccagagccccgccgccgcggcggcgcaccaggagatgatggccacgctgatggtgcccaagaaggaggcggcggacgaggccggcaggaacgacctgttcgtggacctcagctacgacgacatccagagcatgtacaacggcctcgacatgatgccgcccggggacgacctgctctactcctccctcttcgcctccccccgtgtccgggggagccagcccggcgccggcggcatgccggccccgttctaagcagagccaagacagagaccgtcagagaccgagatcgacagaagtggaacggatgacttcttcgccgcgagcgagcgagatcgcggagcagtgtaaatacagcataggaaacgggagggaggatgcgtcgtcgtgtctgagagagccggcgtggcgcggtcgccggcgccggggcgtgccgttgtacatggagagcccggtgccggggcctggccggctgggttgattcttttgttcttactactttgtactctcaatgcggatgtagctctttcttctcactcctcactagtagaatcgaccgaccaaatacatatgtagctctgttccttccttctcttcagtagaaatcaaccaaattttgctgttatgctgctatacttctctgatgtcgggcaggatgaattgcctcaattttcagtcagtctgatctactgatctgcctgtgttgtgtttgcctgcctgcttggacacaccaagcacactccggttctgcaggtagctctatgtagctcgagctccagaacgaatttctgatagtattggttcctgtaaaatgctggttagaatagaaatctgaat

SEQ ID NO: 556 - DNA, 1395 bp, Secale cereale
tcaggattcatctactgcaacatcaccggagcgatttcatcaactactactctcttccaactttcaaagcaaaggatatcatggggatgccggccgtgaggaggagggagcgggacgcggaggcggagctcaacctgccgccgggcttccgcttccaccccaccgacgacgagctcgtggagcactacctgtgccgcaaggcggccgggcagcgcctgcccgtgcccatcatcgccgaggtcgacctctaccgcttcgacccctgggcgctccccgaccgcgccctcttcggcacccgcgagtggtacttcttcaccccccgcgaccgcaagtaccccaacggctcccgccccaaccgcgccgccggcaacggctactggaaggccaccggcgccgacaagcccgtcgcgccccgcggtgggcgcaccatgggcatcaagaaggcgctggtgttttacgccggcaaggcgcccaagggggtcaagaccgactggatcatgcatgagtaccgcctcgccgacgccggccgcgccgccgccagcaagaagggctcgctcaggctggacgactgggtgctctgccgcctgtacaacaagaagaacgagtgggagaagatgcagctgcagcagcaggggggagaggagacgacgatgatggagcccaaggaggagaacacggcgtccgacatggtggtcacctcgcagtcccagtcgcagtcccagtcgcactcccactcgtggggcgaggcgcgcacgccggagtcggagatcgtggacaacgacccgtccctgttccagcaggcggcggcgttccagacccagagccccgcggccgccgcggcgcaccaggagatgatggcgaccctgatggtgcccaagaaggaggcggcggacgaggccggcaggaacgacctgttcgtggacctcagctacgatgacatccagagcatgtacaacggcctcgacatgatgccgcccggggacgacctcctctactcctccctcttcgcctcccccagggtgagggggagccagcccggcgccggcggcatgccggccccgttctaagcagagcaaagacagagaccgtcagagaccgagatcgacggaagcggaatggacgacttcttcgccgcgagcgagatggcggaccagtgtaaatacggaataggaaacgggagggaggtcgcgtcgtgtctgagagaagccggcgtggtgcgggcgccggcgccggggcgtgccgttgtacatggagagcccggtgccggagcctggccggctgggttgattcttttgttcttgctttgtactctcaatgcggatgtagctctttcttctcactcctcggtagtagaatcgaccaaatacatatgtagctctgtttcttcagtagaat

SEQ ID NO: 557 - DNA, 1437 bp, Aegilops tauschii
cacagctcgctcaccacaatctcaacagccatcggaatcaacagcagcagcagcggagcgatctcatcgaccaactctcttccaagtttcgattcaacggacatggggatgccggcggtgaggaggagggagagggacgcggaggcggagctcaacctgccgccgggcttccgcttccaccccaccgacgacgagctcgtggagcactacctgtgccgcaaggcggccggccagcgcctgcccgtgcccatcatcgccgaggtcgacctctaccgcttcgacccgtgggcgctccccgaccgcgccctcttcggcacccgcgagtggtacttcttcaccccgcgcgaccgcaagtaccccaacggctcccgccccaaccgcgccgccggcaacggatactggaaggccaccggcgccgacaagcccgtcgcgccccgcggtgggaggaccatggggatcaagaaggccctggtgttttacgccggcaaggcgcccaagggggttaagaccgactggatcatgcatgagtaccgcctcgccgacgccggccgcgccgccgccagcaagaagggctcgctcaggctggacgactgggtgctctgccggctctacaacaagaagaacgagtgggagaagatgcagctccagcagcaggggggagaggagatgatggtggagcccaaggaggagcacgccgcgtcggacatggtggtcacctcgcactcgcactcgcactcgcagtcccagtcgcactcgcactcgtggggcgaggcgcgcacgccggagtcggagatcgtcgacaacgacccgtcgctgttccagcaggcggcggcgttccaggcccagagccccgccgccgccgcggcgcatcaggagatgatggccacgctgatggtgcccaagaaggaggcggcggacgaggccggcaggaacgacctgttcgtggacctcagctacgacgacatccagagcatgtacaacggcctcgacatgatgccgccaggggacgatctgctctactcgtccctcttcgcctccccccgcgtccgggggagccagcccggcgccggcggcatgccggccccgttctaagcagagccaagacagagaccgtcagataccgagatcgacagaagtggaacggatgacttcttcgccgcgagcgagcgagatcgcggcgcagtgtaaatacagcataggaaacgggagggaggtcgcgtcgtcgtgtcgagagagccggcgtggcgcgggcgccggcgccggggcgtgccgttgtacatggagagcccggtgccggggcctggccggctgggttgattcttttgtttttactactttgtactctcaatgcggatgtagctctttcttctcactcctcagcagtagaatcgaccgaccaaatacatatgtagctctgtttcttcagtagaaatcaac

SEQ ID NO: 558 - DNA, 1487 bp, Avena sativa
cacacaattcacaacaccacagaggaatcatcatcatcaacagcaggagctcagagtagtgatccaaagcaaaggagcaagctttcagacagacagacagagaggatcgctcgcttactacagacgacgcccatggggatggccgtgcgcaggcgcgagagggacgcggaggcggagctgaacctgccccccgggttccggttccacccgacggacgacgagctcgtggagcactacctgtgccgcaaggccgccgggcagcgcctccccgtgcccatcatcgccgaggtcgacctctaccgcttcgacccctgggcgctccccgaccgcgccctcttcggcacccgcgagtggtacttcttcacgccccgcgaccgcaagtaccccaacgggtcccgacccaaccgcgccgccgggaacgggtactggaaggccaccggggccgacaagcccgtcgcgccgcgcggcgggcgcaccatggggatcaagaaggcgctggtgttttatgccgggaaggcgccgaaaggggtgaagacggactggatcatgcacgagtacaggctcgccgatgccgggagagccagcgccagcgccaagaagggatccctcaggttggacgactgggtgctgtgccgtctgtacaacaagaagaacgagtgggagaagatgcagcagcagggggagcagaaggtggagcccaaggcggaggaggcgtctgcggcgtcggacatggtgacctcgcagtcccactcgcactcgtggggcgaggcgcgcacgccggagtcggagatcgtggacaccgacccggcgctattccagcaggcggcggcggccgggttccagagccccgtggcggcggcggcgcaccaggagatgatggcgacgctgatggtgcccaagaaggaagcggcggacgagggccggaacgacctgttcgtggacctcagctacgacgatatccagagcatgtacagcggcctcgacgtgatgccgcccggggacgacctgctctactcgtccctcttcgcctcgcccaggctccgcgggagccagcccggcgccggcggcggcatgccggggcccttctgagctgaacgaggatggatcggaacgaaacctgagagaaatggaacgacgactagttctgcgccgcgagctcgcggacggatcatcagtgtacatacaggatagggaaacgggagaagaggccgcgcgcgtggtgtcgagagatcgagccgtggcgttgtgtgcggcgccggcgccggggcgtgctgtatatcgagagcctggtgctggggctgggtcattctttcgtttttacttgttactcagagtactcacatacatagtagtatgtactatagctcctttccccttgttctcttcagcagtggaacccaccaaattttgatgttcttcaacaactgcttgctgttactgtacttttttactttggttgtcaggctcgggcagaatggtttactctt

SEQ ID NO: 559 - DNA, 1455 bp, Avena sativa
acgcagccgccgccgggaggatccccctcctcccctcctccgaaccttccagaccacacccgcccgcctatttatccccccaagcccacagtttcccctctccattcatcaccaccaccacacaattcacaacaccacagagggaatcatcatcatcatcaacagcaggagctcagagtggtgatccaaagcaaaggagcaagctttcagacagacatacagagagagaggatcgctcgcttactacagacgacacacatggggatggccgtgcgcaggcgcgagagggacgcggaggcggagctgaacctgccccccgggttccggttccaccccacagacgacgagctcgtggagcactacctgtgccgcaaggccgccgggcagcgcctccccgtgcccatcatcgccgaggtcgacctctaccgcttcgacccctgggcgctccccgaccgcgccctcttcggcacccgcgagtggtacttcttcacgccccgcgaccgcaagtaccccaacggctcccgacccaaccgcgccgccgggaacgggtactggaaggccacgggggcggacaagcccgtcgcgcctcgcggcgggcgcaccatggggatcaagaaggcgctggtgttttatgccgggaaggcgcccaaaggggtgaagacggactggatcatgcacgagtacaggctcgccgatgccgggcgggccagcgccagtgccaagaaggggtccctcaggttggacgactgggtgctgtgccgtctgtacaacaagaagaacgagtgggagaagatgcagcagcaaggagagcagaaggtggagcccaaggcggaggaggcgtctgcggcgtcggacatggtgacctcgcagtcccactcgcactcgtggggcgaggcgcgcacgccggagtcggagatcgtggacaccgacccggcgctgttccagcagcaggcggcagccgcggggttccagagccccgtggcggcggcggcgcaccaggagatgatggcgacgctgatggtgcccaagaaggaggccgcggacgagggcaggaacgacctgttcgtggacctcagctacgacgacatccagagcatgtacagcggcctcgacgtgatgccgcccggggacgacctgctctactcgtccctcttcgcgtcgcccaggctccgcgggagccagccaggcgccgccggcggcatgccgggccccttctgagctgaaccaggatggatcagcatcagcccgagacgagagagaagtggaacaacgacttctgcaccgcgagctcgcggacggatcatcagtgtacatacaggatagggaaacgggagaagaggccgcgcgcgtggtgtcgagagatcgagccgtggcgttgtgtgcggcgccggcgccggggcgtgctgtatatcgagagcctggtgctggggctgggtcattctttcgtttttactt

SEQ ID NO: 560 - DNA, 1318 bp, Avena sativa
cgccgggaggatccccctcctcccctcctccgaaccttccagaccacacccgcccgcctatttatccccccaagcccacagtttcccctctccattcatcaccaccaccaccacacaattcacaacagcacagaggaatcatcagtaacagcaggagctcagagtgatccaaagcaaggagcaagctttcagacagagagaaagaggattgctcgcttactacagacgacacacatggggatggccgtgcgcaggcgcgagagggacgcggaggcggagctgaacctgccccccgggttccggttccacccgacggacgacgagctcgtggagcactacctgtgccgcaaggccgccgggcagcgcctccccgtgcccatcatcgccgaggtcgacctctaccgcttcgacccctgggcgctccccgaccgcgccctcttcggcacccgcgagtggtacttcttcaccccgcgcgaccgcaagtaccccaacggctcccgacccaaccgcgctgcgggcaacgggtactggaaggccacgggcgcggacaaacccgtcgcgcctcgcggcgggcgcaccatggggatcaagaaggcgctggtgttttatgccgggaaggcgccgaaaggggtcaagacggactggatcatgcacgagtacaggctcgccgatgccgggcgggccagcgccagcgccaagaagggatccctcaggttggacgactgggtgctgtgccggctgtacaacaagaagaacgagtgggagaagatgcagcagcagggggagcagaaggtggagcccaaggcggaggaggcgtctgcggcgtcggacatggtgacctcgcagtcccactcgcactcgtggggcgaggcgcgcacgccggagtcggagatcgtggacaccgacccggcgctgttccagcaggcggcagcggccgggttccagagccccgtggcggcggcggcgcaccaggagatgatggcgacgctgatggtgcccaagaaggaggcggcggatgagggcaggaacgacctgttcgtggacctcagctacgacgacatccagagcatgtacagcggcctcgacgtgatgccgcccggggacgacctgctctactcctccctcttcgcgtcgcccaggctccgcgggagccagcccggcgccgccggcggcatgccgggccccttctgagctgaaccaggatggatcgcaacgaaatctgagagaagcggaacgacgactagttctgcgccgcgagctcgcggacggatcatcagtgtacatacagggtaggaaaacgggagaaagaggccgcgcg

SEQ ID NO: 561 - DNA, 1126 bp, Avena sativa
atcatcatcatcatcaacagcaggagctcagagtagtgatccaaagcaaaggagcaagctttcagacagacagacagagagtgagagaggatcgctcgcttactacagacgacgcacatggggatggccgtgcgcaggcgcgagagggacgcggaggcggagctgaacctgccccccgggttccggttccaccccacggacgacgagctcgtggagcactacctgtgccgcaaggccgccgggcagcgcctccccgtgcccatcatcgccgaggtcgacctctaccgcttcgacccctgggcgctccccgaccgcgccctcttcggcacccgcgagtggtacttcttcacgccccgcgaccgcaagtatccaaacggctcccgacccaaccgcgccgccgggaacgggtactggaaggccacgggcgcggacaaacccgtcgcgccgcgcggcgggcgcaccatggggatcaagaaggcgctggtgttttatgccgggaaggcgccgaaaggggtcaagacggactggatcatgcacgagtacaggctcgccgatgcggggcgggccagcgccagcgccaagaagggatccctcaggttggacgactgggtgctgtgccgtctgtacaacaagaagaacgagtgggagaagatgcagcagcaaggagagcagaaggtggagcccaaggcggaggaggcgtctgcggcgtcggacatggtgacctcgcagtcccactcgcactcgtggggcgaggcgcgcacgccggagtcggagatcgtggacaccgacccggcgctgttccagcaggcggcagccgcagggtttcagagccccgtggcggcggcggcgcaccaggagatgatggcgacgctgatggtgcccaagaaggaggccgcggacgagggcaggaacgacctgttcgtggacctgagctacgacgacatccagagcatgtacagcggcctcgacgtgatgccgcccggggacgacctgctctactcgtccctcttcgcgtcgcccaggctccgcgggagccagccaggcgccgccgccggcggcatgccaggccccttctgagctgaacgaggatggatcggaacgaaatctgagagaaatggaacgacgg

SEQ ID NO: 562 - DNA, 1460 bp, Avena sativa
acgcagccgccgccgggaggatccccctcctcccctcctccgaaccttccagaccacacccgcccgcctatttatccccccaagcccacagtttcccctctccattcatcaccaccaccacacaattcacaacaccacagagggaatcatcatcatcatcaacagcaggagctcagagtagtgatccaaagcaaaggagcaagctttcagacagacatacagagagagaggatcgctcgcttactacagacgacgcacatggggatggccgtgcgcaggcgcgagagggacgcggaggcggagctgaacctgccccccgggttccggttccacccgacggacgacgagctcgtggagcactacctgtgccgcaaggccgccgggcagcgcctccccgtgcccatcatcgccgaggtcgacctctaccgcttcgacccctgggcgctccccgaccgcgccctcttcggcacccgcgagtggtacttcttcacgccccgcgaccgcaagtaccccaacgggtcgcgccccaaccgcgccgccggcaacgggtactggaaggccaccggggccgacaagcccgttgcgccgcgcggcgggcgcaccatggggatcaagaaggccctggtgttctacgcggggaaggcgccgaaaggggtcaagaccgactggatcatgcacgagtacaggctcgctgatgccgggagagccagcgccagcgccaagaagggatccctcaggttggacgactgggtgctgtgccgtctgtacaacaagaagaacgagtgggaaaagatgcagcagcagggggagcagaaggtggagcccaaggcggaggaggcgtctgcggcgtcggacatggtgacctcgcagtcccactcgcactcgtggggcgaggcgcgcacgccggagtcggagatcgtggacaccgacccggcgctgttccagcaggcggcagcggccgggttccagagccccgtggcggcggcggcgcaccaggagatgatggcgacgctgatggtgcccaagaaggaggcggcggacgagggccggaacgacctgttcgtggacctcagctacgacgacatccagagcatgtacagcggcctcgacgtgatgccgcccggggacgacctgctctactcctccctcttcgcgtcgcccaggctccgcgggagccagcccggcgccggcgccggcggcatgccgggccccttctgagctgaacgaggatggatcgcaacgaaatctgagagaagcggaacgacgactagttctgcgccgcgagctcgcggacggatcatcagtgtacatacagggtaggaaaacgggagaaagaggccgcgcgactagtgtcgagagatcgagccgtggcgtggtgcggcgccggcgccggggcgtgctgtatatcgagagcctggtgctggggctgggccattctttcgtttttacatgttactcgg

SEQ ID NO: 563 - DNA, 1211 bp, Avena sativa
gccattcatcaccaccaccaccacacaattcacaacagcacagaggaatcatcagtaacagcaggagctcagagtgatccaaagcaaggagcaagctttcagacagagagaaagaggattgctcgcttactacagacgacacacatggggatggccgtgcgcaggcgcgagagggacgcggaggcggagctgaacctgccccccgggttccggttccacccgacggacgacgagctcgtggagcactacctgtgccgcaaggccgccgggcagcgcctcccggtccccatcatcgccgaggtcgacctctaccgcttcgacccctgggcgctccccgaccgcgccctcttcggcacccgcgagtggtacttcttcacgccccgcgaccgcaagtaccccaacgggtcgcgccccaaccgcgccgccgggaacgggtactggaaggccaccggggcggacaagcccgtcgcgccccgcggcgggcgcaccatgggtatcaagaaggcgctggtgttttacgccgggaaggcgccgaagggggtgaagacggactggatcatgcacgagtaccggctcgctgatgctgggagagccagcgccggcgccaagaagggctccctcaggttggacgactgggtgctgtgccggctgtacaacaagaagaacgagtgggagaagatgcagcagggggagcagaaggtggagcccaaggcggaggaggcgtcggcggcgtcggacatggtgacgtcgcagtcccactcgcactcgtggggcgaggcgcgcacgccggagtctgagatcgtggacaacgaccctgcgctgttccagcaggcggcggcggcggcggggttccagagccccgtggcggcggcgcaccaggagatgatggcgacgctgatggtgcccaagaaggaggcggcggatgagggcaggaacgacctgttcgtggacctgagctacgacgacatccagagcatgtacagcggcctcgacgtgatgccgccaggggacgacctgctctactcgtccctcttcgcgtcgcccaggctccgcgggacccagcccggcgccggcggcggcatgccggggcccttctgagcatgtcgaggccggtgaggcaagagacctggatcgaccgaaatcgggagaagtggaatgacttccttgggcgccgcggcgagctcgcggacggatcgcgctgtacatacagg

SEQ ID NO: 564 - DNA, 1044 bp, Avena sativa
accaccaccacacaattcacaacaccacagagggaatcatcatcatcatcatcaacagcaggagctcagagtagtgatccaaagcaaaggagcaagctttcagacagacagacagagaggatcactcgcttactacagacgacaccacatggggatggccgtgcgcaggcgcgagagggacgcggaggcggagctgaacctgccccccgggttccggttccacccgacggacgacgagctcgtggagcactacctgtgccgcaaggccgccgggcagcgcctccccgtgcccatcatcgccgaggtcgacctctaccgcttcgacccctgggcgctccccgaccgcgccctcttcggcacccgcgagtggtacttcttcaccccgcgcgaccgcaagtaccccaacggctcccgacccaaccgcgctgcgggcaacgggtactggaaggccacgggcgcggacaaacccgtcgcgcctcgcggcgggcgcaccatggggatcaagaaggcgctggtgttttatgccgggaaggcgccgaaaggggtcaagacggactggatcatgcacgagtacaggctcgccgatgccgggcgggccagcgccagcgccaagaagggatccctcaggttggacgactgggtgctgtgccgtctgtacaacaagaagaacgagtgggagaagatgcagcagcaaggagagcagaaggtggagcccaaggcggaggaggcgtctgcggcgtcggacatggtgacctcgcagtcccactcgcactcgtggggcgaggcgcgcacgccggagtcggagatcgtggacaccgacccggcgctgttccagcagcaggcggcagccgcggggttccagagccccgtggcggcggcggcgcaccaggagatgatggcgacgctgatggtgcccaagaaggaggccgcggacgagggcaggaacgacctgttcgtggacctcagctacgacgacatccagagcatgtacagcggcctcgacgtgatgccgcccggggacgacctgctctactcgtccctctt

SEQ ID NO: 565 - DNA, 1827 bp, Zea mays
ttcataagtcgtctttctccttgaccagccattagcgtcgatcgatgatttagcacggagaggctcaaggctgtccacacagcctggattgttcgatcgttcttggagctcgcagctggagcgagagagtaatctcatgcccgctcttcttctgtagattgatggaatgatcagtaacctttatccatccatccatccatccagggattttaatttgttcagagaactaaaatttgattcctggtttttgactcagcgtagactctaaacaagcttacagcccggatgcgtcgccgacatggtgaatgcagtggctacaatcatatctacagtagcctcaactgcgacagtggtagtaatcgtcgccctcatcagaaggtgccgcgtcgtgaggaagaagatgaagaagaaaatcgtgaagaaagtcctggaggagattgagaaaaagaaccgcgagatgcaggccagcaacgccgtggaagatgtggcgatcgaggtcgggccagtggagacgtttctcaaccagatcctcaacgagaagccgatgcgtttcagctccgagcagctggcggcctgcacccggaactactcgtcggagctagggtccggcggctacggcgtggtctacaagggcgagctgccgaacggcctgctggtggccgcgaaagtcctcaaggtgtcgtccatgaacaggaaggtccaggaggcgttcatggcggagatcggcaccatcggccggacgtaccacgtgcacctcgtccgcctctacggcttctgcttcgacgcgagcaccaaagcgctagtgtacgagttcctggagaacggctcgctggagaagtacctttacggcggtgacgagggcagcacgacgagcacgaggctggagtgggggacgctgcacggcatcgccgtcggcacggccaaggggatcaggtacctgcacgaggagtgccagcagcggatcgtgcactacgacatcaagccggccaacatcctcctcacggccgactacaccccgaaggtggcggacttcgggctggcgcggctgggagagcgcgagaacacgcacatgtcgctgaccggcggcggccgcgggacgcctgggtacgcggcgccggagctgtggatggcgatgccggcgtcggagaagtgcgacgtgtacagcttcgggatggtgctgttcgagatcctgggacggcgccggaactacgacccctgccttgagggcgagagcaaggagtggttcccgagatgggtgtgggagaagtacgagcagggtgagatcgagcacgtcgtgtcctgctcctgcgacgggatcgtcggaggggcggacagggagaaggcggagatcatgtgcaaggtggcgctgtggtgcgtgcagttccagccgtcggcgcggccgacgatgagcagcgtggtgcggatgctggagggggagatgcccattgtcccgcccgtgaacccgttccattatctcatggaaagcggcggcggctcaactagctcgggattgtggagcggcacataccagagcagcagcagagacaccgccggcgcagagttgtcgcctgtcggatagctctgctgccaggtcaatcggcgtcgacgcgccgtgatcgaagatgttgagcggactcgtggggggtcgtgttgatgaaacagagtttgtagtcctgtagtacacgttagttaatgctttaaaataacaatgaaggccgtggtttgtaaattagcatcgtgttttggaggattatataaaagataaaagattcgcgcacgacaaaaaaaaatcgtgcatgcgttgagtgaaatgtacttgtaccggca

SEQ ID NO: 566 - DNA, 1629 bp, Zea mays
atcgatgatttagcacggagaggctcaaggctgtccacacagcctggattgttcgatcgttcttggagctcgcagctggagcgagagagtaatctcatgcccgctcttcttctgtagattgatggaatgatcagtaacctttatccatccatccatccatccagggattttaatttgttcagagaactaaaatttgattcctggtttttgactcagcgtagactctaaacaagcttacagcccggatgcgtcgccgacatggtgaatgcagtggctacaatcatatctacagtagcctcaactgcgacagtggtagtaatcatcgccctcatcagaaggtgccgcgtcgtgaggaagaagatgaagaagaaaatcgtgaagaaagtcctggaggagattgagaaaaagaacagcgagatgcagggcagcaacgccgtggaagatgtggcgatcgaggtcgggccagtggagacgtttctcaaccagatcctcaacgagaagccgatgcgtttcagctccgagcagctggcggcctgcacccggaactactcgtcggagctagggtccggcggctacggcgtggtctacaagggcgagctgccgaacggcctgctggtggccgcgaaagtcctcaaggtgtcgtccatgaacaggaaggtccaggaggcgttcatggcggagatcggcaccatcggccggacgtaccacgtgcacctcgtccgcctctacggcttctgcttcgacgcgagcaccaaagcgctagtgtacgagttcctggagaacggctcgctggagaagtacctttacggcggcgacgagggcagcacgacgagcatgaggctggagtgggggacgctgcacggcatcgccgtcggcacggccaaggggatcaggtacctgcacgaggagtgccagcagcggatcgtgcactacgacatcaagccggccaacatcctcctcacggccgactacaccccgaaggtggcggacttcgggctggcgcggctgggcgagcgcgagaacacgcacatgtcgctgacgaccggcggcggccgcgggacgcccgggtacgcggcgccggagctgtggatggcgctgccggcgtcggagaagtgcgacgtgtacagcttcgggatggtgctgttcgagatcctgggacggcgccggaactacgacccctgccttgagggcgagagcaaggagtggttcccgagatgggtgtgggagaagtacgagcagggtgagatcgagcacgtcgtgtcctgctcctgcgacgggatcgtcggaggggcggacagggagaaggcggagatcatgtgcaaggtggcgctgtggtgcgtgcagttccagccgtcggcgcggccgacgatgagcagcgtggtgcggatgctggagggggagatgcccattgtcccgcccgtgaacccgttccattatctcatggaaagcggcggcggctcaactatctcgggattgtggagcggcacataccagagcagcagcagagacaccgccggcgcagagttgtcgcctgtcggatagctctgctgccaggtcaatcggcgtcgacgcgccgtgatcgaagatgttgagcggactcgcggggggtcgtgttgatgaaacagagtt

SEQ ID NO: 567 - DNA, 1026 bp, Saccharum officinarum
gagagaggaggagagcagctccaatccaacgccggaacgcgccgggggagaaggaaaggaggggaacggacgaacatggggaagggcgtcctggaagtgcacctcgtcgacgccaagggcctctccggcaacgatttcttagggaagctggacccctacgtgatcgtgcagtaccggagccaggagcgcaagagcagcgtcgcccgagaccaagggaggaacccgtgctggaacgaggtgttcaagttccagatcaactccgccgcggccaacgcgcagcacaagctcatcctccgcatcatggaccacgacaacttctccagcgacgacttcctcggcgaggcgacgatcgacgtgacggacatcgtcagcctgagcgcggagcgcggcacgtaccacctcaacgcggccaagcacaacgtggtgctcgccgacaagacgtaccagggcgagatcaaggtcggcatcaccttcaccgccacccaggttcaggaagatggaggagcaattggagggtggaggcacagtagctttaatcagtgaaaggcgaaggccgtggtgaactgaactctcaaggtctttggttgctagtagcttggtagtggttcgggtgaatggatagttttgtttatctacacgagcacatctggaattctgtattgaagactggttaaaaccggcaaaatccgtatgacttttaagaaaaaaaaaaaaaaagggcgggcggtctttaagatcccagctttcttacccttgcatgcgaaatccatagctttttttatagggggcaccttaaatttcaattctcctggccggtggttttacaaacgtcgggacttgggaaacccctggcggtttcccaactttaattggccttggtaggatcactcccttttgtcccaggtggcgtataattccaaagagagacccgaacctatacgactttacccaaaggtggctaaaattctgatttggtataggtaaaccgcctcttctgatggatcctataatctcccgctggatttg

SEQ ID NO: 568 - DNA, 721 bp, Sorghum bicolor
cacgtactccttccgtccatagctgggggattgcataacctcgtaccaccacgtacgaaaccgataggagcggagggtgagacgacgcgatcgacgtgggcagcaaattaaagatgcagatcttcgtgaagacgctgacggggaagacgatcacgctggaggtggagagcagcgacaccatcgacaacgtgaaggcgaagatccaggacaaggaaggcatcccgccggaccagcagcggctcatcttcgccgggaagcagctggacgacggccgcaccctggccgactacaacatccagaaggagtcgacgctgcacctggtgctgcgcctccgcggcggcagcaggggcggctaccccacgaccatctcgcccagcctccgcgagctcgcgcagaagtacaacgagaacaagatggtctgccgcaagtgctatgcacggcttccgcccagggcaaccaactgccgcaagaagaagtgtggccacaccaacgcgctgaggtcaaagaagaggttcatgtctaagattggtggaacaaataaatgagcgttggagagccttgtcatgcatcagttaggaattttgggatgctattttactttcctttgctttttatgaataaagttgtggtaggagaaagtgtgctactcttggttaataagatgtttttatataaattattattactattattgttatattcattggttataagtgagata

SEQ ID NO: 569 - DNA, 591 bp, Setaria italica
ctacatacatcccaccaaaaccaaaaccgcaagttcgacgacgacaccctcggcggccaagatgcagatcttcgtgaagacgctgacggggaagacgatcaccctcgaggtggagagcagcgacaccatcgacaacgtcaaggccaagatccaggacaaggagggtatcccgccggaccaacagcgcctcatcttcgccgggaagcagctcgaggacggccgcaccctcgccgactacaacatccagaaggagtcgacgctgcacctggtgctgcgcctccgcggcggcagcaggggcgggtaccccacggggatcgagcccagcctccgcgagctcgcgcagaagtacaacgagaacaagagggtctgccgcaagtgctatgctcggcttcccctcagggctaccaactgccgcaagaagaagtgtggccacaccaacgagctgaggtcaaagaaaaggttcatgtccaagaatggcggagcttgagcttggagcgggctgtcatgcatcacattgaaatattttagtttccaatgtttagatgtcgaacgtttctttctttatgaatttatgaataaagtttagctggg

SEQ ID NO: 570 - DNA, 1460 bp, Pseudoroegneria spicata
acaccacaccacacaactcactctcatcacatctcaaacaacagcccgaggatttcatcaacagcagcaacatcaccggagcggccgatttcagccaggccagccagcgactctcttgcagacatggggatgccggccgtgaggaggagggagagggacgcggaggcggagctgaacctgcccccgggattccgcttccaccccaccgacgacgagctcgtcgagcactacctgtgccgcaaggcggccgggcagcgcctgcccgtgcccatcatcgccgaggtcgacctctaccgcttcgacccgtgggcgctccccgaccgcgccctcttcggcacccgcgagtggtacttcttcaccccgcgcgaccgcaagtaccccaacggctcccgccccaaccgcgccgccggcaacggctactggaaggccaccggcgccgacaagcccgtcgcgccccgcggcggccggaccatggggatcaagaaggccttggtgttttacgccggcaaggcgcctaagggggttaagaccgactggatcatgcacgagtaccgcctcgccgacgccggccgcgccgccgccagcaagaagggctcgctcaggctggacgactgggtgctgtgccgtctgtacaacaaaaagaacgagtgggagaagatgcagctccatcaggagcaggacggggagatgatggtggagcccaaggcggagaacacggcgtcggacatggtggtgacctcgcactcccactcgcagtcccagtcgcactcgcactcgtggggcgaggcgcgcacgcccgagtcggagatcgtggacaacgacccgtcgctgttccagaaggcggcggcgttccagacccagagccccgcggcggcgcaccaggagatgatggcgacgctgatggtgcccaagaaggaggcggccgatgagggcaggaacgacctgttcgtggacctcagctacgacgacatccagagcatgtacaacggcttcgacatgatgccgcccggggacgacctcctctattcgaccctcttcccctcccccagggtccgggggagccagcccggcgccggcggcatgccggccccgttctaagcagagcacaggctcaagacgagactgtcagaccgagatcgacagaagtggaatggtgactccttcgccgcgagcgagatcgcggtgcagtgtaaatacagcataggaaacgggagggaggtggcgtcgtgtcgagagagccggcgtggcgtgggcgccggcgccggggcgtgccgttgtacatggagagcccggtgccggggcctggccggctgggttgattcttttgttcttactttgtactctcaatgcggatgtagctctttcttctcactcctcagtagtagaatcgaccaaatacatatgtagctctgtttctttcttatcgtcagtagaatcaactaacaaattttgcagctcta

SEQ ID NO: 571 - protein, 357 aa, Hordeum vulgare
MASSGSLAGLAVLLTAVLCLQLPVHSRAQLRVGFYNTTCPNAEAIVRQAVTAAFATNSGVAAGLIRLHFHDCFVEGCDSSVLLSVNPGGGTTERDAAPNNPSLRGFEVVNAARAALEQSCPRTVSCADILAFAARDSVNITGSNAFYQVPSGRRDGNLSTDAGAFTLPGPNLTAAGLVTGFEMRGLNAEDMVVLSGSHTLGRSHCSSFIFKNRERLASGTISPAYQALLEALCPANTGQFTNVTTEIDLSTPVVLDNNYYKLVQLNLGLHFSDDQLIRNATLKAFVDAFAANETLWKDKFIAAMIKMGNIAPKTGTQGQIRLNCSLVNPSSSSSSASYAGAIEMLRRPGSHDKVAMA

SEQ ID NO: 572 - protein, 297 aa, Hordeum vulgare
MHANKSLASRIHHITNEARHAMAPSSSSPLPASPLLVLLMVPLLLAMARPCSGVDAIGTYCAKNGTSAETQASIDQVLAALVPRASAAYYATATAGRSSSAVWGLAQCRGDVPRQDCSLCLAAAAKEVASSCRGSSDGRVFYDYCLLRYSTANFIGLADTGYTLILLNTQNATGVDLAAFDRAQGKLMSRVASEAGDAANKGLATDTTRLGSDGGGAKTTIYGLGWCTRDITAADCGLCVAQAVAELPNYCRYRRGCRVIYSSCMARYEVYPFFFPLDGADKSADEVGQCDKIVLNA

SEQ ID NO: 573 - protein, 475 aa, Hordeum vulgare
METTVTAVSGTTSSSVGHGAGGGAARVLLLPSPGAQGHTNPMLQLGRRLAYHGLRPTLVATRYVLSTTPAPGAPFDVAAISDGFDAGGMALCPDPAEYFSRLEAVGSETLRELLLSEARAGRPVRVLVYDAHLAWARRVAQASGVAAAAFFSQPCSVDVVYGELWAGRLALPATDGRALLARGVLGVELGLEDMPPFAAVPESQPAFLQVSVGQFEGLDYADDVLVNSFRDIEPKEVEYMELTWRAKMVGPTLPSYYLGDGRLPSNKSYGFDLFNSDVECMDWLEKQMNSSVVLVSYGTVSNYDATQLEELGNGLCNSSKPFLWVVRSNEEHKLSEELKEKCGKIGLIVSWCPQLEVLAHRAIGCFVTHCGWNSTLEALVNGVPFVGIPHWADQPTIAKYVESAWGMGVRARKNKNGCLKKEEVERCIREVMDGERKDEYKKNAMNWMQKAKEAMQEGGSSDKHVAEFATKYSSI

SEQ ID NO: 574 - protein, 233 aa, Hordeum vulgare
MEGAGSGCKMGGGEGMSGRAGAGAAAAAKEKSGFAATCSLLSRYMKEKKGGALQGLVGLDMAPPAAVVVGGGAFQPPTTMNLLSGLEEPNTAGVELALEKSSVGQLLKAPTDNQDAREDAHQLTIFYGGKVVVVDNFPSTKVNGLLQMANGAGDAGDKAGSSSLVQQSPPQPAHNTLPDLPIARRNSLHRFLEKRKGRIVAKAPYQISSSSAAPSKQANGDNAWLGLGQEVTN

SEQ ID NO: 575 - protein, 87 aa, Hordeum vulgare
MAMERFFTGLVFCEAPLDGYGTSVLTAGVVKTLVLSGGTATKPAAVASRADADKDQGSSNGKRTAQRSAGFEIAFDGLNCFDTVVMH

SEQ ID NO: 576 - protein, 311 aa, Hordeum vulgare
MAAKATSCFTFLKEALVLPTQNPKLFAPIFILLAVIAFLVPAVNVVFIQPLTAEMLRHLAEMQTTDPSTAEFARLLQEIRQETRELVIITVALTVVTLVLVFAKQILSFSAACTTYSGDRYTLAELLRRLTKWGNLRGPLVTVGVVTALQLTFMVLLGVYLSSVMRHSGLLSVQGALFVLAFLAFIYFGVVAVVGVAVSVADEGCRGVRALGRAWRLMTRVSRKEGALLAAVMVLLPTVLSPVSALALAYAKKSMAVGLCLLAVQALLSGAVELFYIAAATVYYYKAMESKGVMVLAFDGYAKIPSREANV

SEQ ID NO: 577 - protein, 527 aa, Hordeum vulgare
MNPESAMSELPWSYLAFGLLGLVLLWPATRLLDQLWWRPRRLERALRAKGLRGTSYRFLTGDMSDYGRQNKEAWSKPLPLRCHDIGAHVMPFIYNNVQEHGKQFISWFGPVPKVSITDPSLVREVMSNKFGHIQKIKFPALSKLLAVGVANHEGEKWVKHRRILNPAFHVEKLKIMLPAFSSCCEELVNKWTQSLGPDGSWEVDVSLELQSLTGDVISRTAFGSSYLEGRRIFQLQSEQVGRFMAAIHKIMIPGYMSFPTENNRRMRQINNEIESILRGLIGKRMQAMQEGGSTNDDLLGLLLESNKTDVNENGQSIPGMSVEEVIEECKLFYFAGMETTSILLTWTMVVLSMHPEWQDRAREEVLGLFGEHKLDYEGLNRLKTVTMILYEVLRLYPPASAFTRQTYKEIEIGGVTYPPGVIFEMSVLHIHHDKDIWGDDVHRFRPDRFANGISKASKEPGAFFPFGWGPRLCIGQNFALLEAKMALCMILRRFEFELAASYTHAPHTVMMLRPMHGAQIKLRAISS

SEQ ID NO: 578 - protein, 320 aa, Hordeum vulgare
MGTLVGHVAPGAGFLLIGLWQLFNHIRLFSLRPGSYAAPVWFPARGVRHLELILVIVGTSMSILMELVIGPAKHQPFDDDGTIPSDHLHNFEHASISLALLAFAAVTIHMDRVRAPMRDAVSQLAAAAAFAQQLLIFHLHSADHMGVEGQFHWLLQAVIAVTLVTTVLGIPYPRSFVVSLVRSASLVFQGVWFIVMGVMLWTPGLIPKGCFLNREDGHDVVRCRTDEALHRAKSLVNLQFSWYLTGTLVFVVAFYLQVSRLYPEEPQYLPLVKGGRAGGRFSIGDDDDHEDDDDEDDDMEAAKRGYGHVVSGTKPMEVER

SEQ ID NO: 579 - protein, 490 aa, Zea mays
MGGGNGETTQLGEPLLAKKAKAYRPRCPGCRVDRLNAEREGVFPLKDLFLIWLVTITCTLPIQSLFPFLYFMIRDLHIAKQTQDIGFYAGFVGASYMCGRAVSSTVWGIVADKYGRKPVIVLTLIAIVIFNTMFGLSSNYWMALITRCLLGIMCGYLGPIKAYATEVCRKEYNHLALAVVSSSRGIGLIIGPAIGGYLAQPADKYPSIFSQTSIFGRFPYFLPCLCISILAVIALIACIWFPETLHKHNGDAVDNSVETVEESLAGTDTEENGGGGCLKLFTNWPLMSAITLYCIFSLQDVAYAETFSLWAVSDRSFGGLSFTTTDVGNVLAMSGLFLFLYQMLIYPFLAKTVDHITLVRAVALLTLPVLASYPFFPSLSGFGLMVVVNCASFLKNTFSVTTITVFNILMNEAVTQDVRAAANGIAVTLMSISKAVAPAVAGIIFSWAQRRQTAAFLPGDHLVFFILNIFTFIGFVFTFRPFFVRGSAKH

SEQ ID NO: 580 - protein, 88 aa, Zea mays
MAGAAKASWMVAMSVGAVEALKDQGGLCRWNYALRSVHRTAKANVRSSLAAQRDKELAPAAESKRRPGKAAAEEGMRTVMYLSCWGPN

SEQ ID NO: 581 - protein, 168 aa, Zea mays
MDDCGKPFVKRELRLSLNPAPCGDDNPTTPTGAASDGGSSACTSAVALFVLGLNSAIAIYGSRHDPQSILFVAVSFFCVVLLFHLLRAFERTPPGSPRRLQVKAAIWVVTTALTVMFSGRVAPLMPAPVAAVVWSMAAVTILAGFYMFFVCPDAAEERPTSKVVAEGP

SEQ ID NO: 582 - protein, 312 aa, Zea mays
MGISHPLSDEYDALRGAVLSPDTTPPSSPLAHRHLLEHEVTRMDTLAGIAIKYGVEISDIKRANSLVTDSQMFAHKSLLIPLPGMPMPSLNACGQRTIRTCAPNHRQKRDAPKSRQQGASSAMNTLQRYYGLTPPQKGGNTMDSSTELSVYHKGGGFQSNLSETLLNPSAAPGTDSSWNFEALGFSATEGDGGAPKPEQDGSMRRRQKVEAESNAQGDFLVKAIKSLLISSVRLDTYAGSPGSSQKSGFRSVTVRKSPSAPSFADADNGVSMWSSSKWTFSHDSFTRPLLDGLPKPASARRTNQNRVGLKLN

SEQ ID NO: 583 - protein, 548 aa, Zea mays
MMGCFTVLRSKKKKSHFDNPLVPSKKSVDARESTSSRLPEPEVHVPSLQSAPPSFRNRVKISESSNEVSNRNSRARVLSAPSALIVVDQFGFPYSEYRDQDDSRDKEGLTKGHRFSNPLPLPLPSREGHSFRNSGSFKASNVSGPLEMSGPLPLPLKKCDGLRIFSYEEISSACQRFSSDQCVSETLGSTSYKATFRDEFIDTRTTEATVARLLPSTQSLKEFKTQATTLASLQHPNLCKLIGYYAKEDSNERMLVYERLYHGSLDKLLFGRSDGRFMDWSKRLKVALGAARGLAFLHDEGPFQAMYSEFSTLNIQIDKGFTAKLSGYGCVGFNTEEISNAPVSAANLSVETLEKGLLTPKSNVWSFGVVLLELITGRKNLDPNYSKEERNIVNWSRPFLTDDSRLSLIMDSRIKGRFPTKAARIVADIILKCLRKDPSERPTMRDVVEALARVQEIKVPCRYPLQEPSAAPRKVMLKSTSLNGIVPHHPVITFSPSPPSHNQHLISPRSSTSALFHPRACSSTLDDPSVSSIKKTPPIMRRSSVEGF

SEQ ID NO: 584 - protein, 227 aa, Zea mays
MAGSAPATAMDKTSFATTCSLLSQYVKEKKGGLLQGLGALAMAPAAGEGAFRPPTTMNLLSALDDAPAEERSEKATAGEPKHQDKCTGGNPREEAAGEEEEEAQQLTIFYGGRVVVFDMFPSAKVEDLLQIMSPGGDGVDRAGGATVPTRSLHRPSHDSLSDLPIARRNSLHRFLEKRKDRITAKAPYQQVNSSVVGVEASKQAAGAGVEKPWLGLGQEATTAKLEM

SEQ ID NO: 585 - protein, 233 aa, Zea mays
MAASARPGERATSFAVACSLLSRFVRQNGVAAADLGLRIKGEVEQQRTPATTNSLPGAEGEEVERRKETMELFPQSVGFSIKDAAAPREEQGDKEKPKQLTIFYGGKVLVFDDFPADKAKDLMQLASKGSPVVQNVVLPQPSAAAAVTTDKAVLDPVISLAAAKKPARTNASDMPIMRKASLHRFLEKRKDRLNAKTPYQTAPSDAAPVKKEPESQPWLGLGPNAVDSSLNLS

SEQ ID NO: 586 - protein, 240 aa, Zea mays
MAMSDTGSSFAQWAALYHHHDPAGGPVLPDDDAADAGNGIGSGTATAASPTSGGSSGGSPTTKAAWGQQHLLHGVEGPRVAGKPAAARRRSRASRRAPVTLLNTDAANFRAMVQQFTGVPAPLAGAFRVGDGAPVISFAADYGFPPASSSSAVNVSFFDHQLHRSQQHPAAPPVHRQQQQYAGASPFGGYSSGLVQGGGASDVFPASAEDRMLLQSILAAQMPHMPPVSGANTSSHGFFA

SEQ ID NO: 587 - protein, 599 aa, Zea mays
MKSLQEERAALVPSPWPQQQRKDGGEHDPEQLMDEDDGDDEEDLQDEQHTRTIRTSTKTAEASSSAERRVPAWWRLRRAQKLLVPTRGVGLVIAGLLVLVLLLVVGGGGGANTSRRRWIHLDYASSFLRGGGLRQHQWPPHHVPSPAADLVPIPFSCGGNGSACPRRQTATSPPSPSPSSSSPPAGTKSSSSKNKQPPPQCPDYFRFIHSDLSPWRETGITREAVERGRHRAAFRLVVVDGRAYVETYHRVFQTRDTFTQWGIAQLLARYPGRVPDLDLMFNCEDMPEVKVKPSEESSAPPLFRYCKDDSTVDIVFPDWSFWGWPEVNIRPWAPLLEEMAAEMGRLPWADREPYAYWKGNPTVSAERADLRRCNDSSSSGGTRVFWQDWGAAIRDGFRDSNLAKQCRYRYKIYVRGRSWSVSLKYILACDSPVLLIATPFKDFFSRGLVAGRHYWPIDPGARKCADINFAVHDWGNAHPEQARRMAEEGSGFARHQLSMDYVYDYMLHLLTQYAGLLRYKPTVPENAVELCAETVACPAAHHSNRREFDFMMQSRERYIADYQPCTLPPPFTDRHIREMTRRDQEVRANVHKMMTTVTP

SEQ ID NO: 588 - protein, 408 aa, Zea mays
MGDAVEDIVIAGAGLAGLATALGLHRKGVRCLVLESSPALRASGFAFTTWTNAFRALDALGVGDKIREHHLLYERMIAFSAATGEAAAEVSLKIQSKSGPHEIRCVKRDFLLRTLADELPEGTIRYSAKVVAMEEDGVGGAKTLQLHLADGSTIKAKVVIGCDGVNSVVAQWLGLPKPILSGRSATRGLAEYPGGHGFGPEILQFIGHGFRSGVLPCSDTSVYWNYTWYPSPADGDAEESVAKMRSHVVAKLRGAKVPAEALEVVERSEMSDVASSPLRFRSPLALVRGSISRGGVCVAGDALHPMTPELGQGGCAALEDGVVLARCLGKAFALLGQERDEGRVVTAALEEYAAARRWRSIQLITAAYVVGFIQQSNNAVVRFVRDRFLSRLLSKTLVAMADYDCGAL

SEQ ID NO: 589 - protein, 415 aa, Zea mays
MEVSRWTPAAGLLLLLLLPLAATPSRAATMARSPSSSTAVFQLQGDVYPTGHYYVTMNIGNPAKPYFLDVDTGSDLTWLQCDAPCRSCNKVPHPLYRPTANRLVPCANALCTALHSGQGSNNKCPSPKQCDYQIKYTDSASSQGVLINDSFSLPMRSSNIRPGLTFGCGYDQQVGKNGAVQAAIDGMLGLGRGSVSLVSQLKQQGITKNVVGHCLSTNGGGFLFFGDDVVPSSRVTWVPMAQRTSGNYYSPGSGTLYFDRRSLGVKPMEVVFDSGSTYTYFTAQPYQAVVSALKGGLSKSLKQVSDPTLPLCWKGQKAFKSVFDVKNEFKSMFLSFASAKNAAMEIPPENYLIVTKNGNVCLGILDGTAAKLSFNVIGDITMQDQMVIYDNEKSQLGWARGACTRSAKSILSSFP

SEQ ID NO: 590 - protein, 1455 aa, Zea mays
MDAAGDIQKVASMRRGDSGSIWRRGDDVFSRSSREEDDEEALRWAALEKLPTYDRVRRAMVPLGLGADGAEAAGRKGLVDVDVLSLGPRERRALLERLVRVADEDNERFLLKLKDRVDRVGIDMPTIEVRFQNLEAEAEVRVGSSGLPTVLNSVVNTIEEAANALHILPSRKRIMPILHDVSGIIKPRRMTLLLGPPGSGKTTLLLALAGRLDKDLKVSGKVTYNGHEMTEFVPERTAAYISQHDLHIGEMTVRETLAFSARCQGVGSRFDMLTELSRREKAANIKPDADIDAFMKASAMGGQDANVVTDYILKILGLEICADTMVGDEMLRGISGGQRKRVTTGEMLVGPARALFMDEISTGLDSSTTFQIVNSLRQSIHILGGTAVISLLQPAPETYNLFDDIILLSDGQVVYQGPREEVLEFFESVGFRCPERKGVADFLQEVTSKKDQKQYWARPNEPYRFVAVKEFATAFKSSHTGRSITNELAVPFDKSKSHPAALTTTRYGVSGKELLKANIDREILLMKRNSFVYMFRTFQLMLMSIIAMTLFFRTKMKHGTVNDGGLYMGALFFGVLMIMFNGFSELALTVFKLPVFFKQRDLLFFPAWSYTIPSWILKVPITFIEVGGYVFLTYYVIGFDPNVGRFFKQYLLLLVVNQMAASLFRFIGGVSRNMIVANVFASFMLLVVMVLGGFILVRDKVKKWWIWGYWISPMMYAQNAISVNEMLGHSWDKILNSTASNETLGVQVLKSRGVFTEAKWYWIGFGAMVGFTILFNALFTVALTYLKPYGNSRPSVSEEELKEKHANIKGEVLDGNHLVSASSHRSTGVNPETDSAIMEDDSALTKRGMILPFVPLSLTFDNIKYSVDMPQEMKAQGVQEDRLELLKGVSGSFRPGVLTALMGVSGAGKTTLMDVLAGRKTGGYIEGDIRISGYPKKQDTFARVSGYCEQNDIHSPQVTVYESLLFSAWLRLPKDVDSNKRKIFIEEVMELVELKPLRNALVGLPGVNGLSTEQRKRLTIAVELVANPSIIFMDEPTSGLDARAAAIVMRTVRNTVDTGRTVVCTIHQPSIDIFEAFDELFLMKRGGEEIYAGPLGHHSSDLIKYFESLHGVSKIKDGYNPATWMLEVTTTSQEQILGVDFSDIYKKSELYQRNKALIKELSQPAPGSTDLHFPSKYAQSSITQCVACLWKQNLSYWRNPPYNTVRFFFTTIIALLLGTIFWDLGGKTYTSQDLMNAMGSMYSAVLFIGVMNCTSVQPVVAVERTVFYRERAAGMYSAFPYAFGQVVIELPYALAQDILYGVIVYSMIGFEWTAAKFFWYLFFGYFTLLYFTFYGMMAVGLTPNYHIAAIVSSAFYAIWNLFSGFIIPRPKVPIWWRWYCWICPVAWTLYGLVVSQFGDVMTPMDDGRAVKVFVEDYFDFKHSWLGWVAAVVVAFAVLFATLFGFAIMKLNFQKR

SEQ ID NO: 591 - protein, 449 aa, Zea mays
MAGMEGSNSSSQPPPFLIKTYEMVEDPATNHVVSWGPGGASFVVWNPPDFSRDLLPKYFKHNNFSSFIRQLNTYGFRKIDPERWEFANDDFVRGHTHLLKNIHRRKPVHSHSPQTQVNGPLAESERRELEDEISRLKYEKSLLLTDLQRQSQQRCGISWQMQSLERRLAQMEERQRNIVASLRDILLPVGHGVVSWGSATGADHFSKKRRVPKMDFFVDEPKVEEQQVPFLQTVGAETPGMSPIRLLSAEPFEKMELALVSLESFLQRATAHTSAAQGMLYAAGVAEPSPALALGEMLSAPMDTEIDLQPSACQNPFASTSGQDQSSSPLAEPPSYYAQSPMLPMAQLHEHAHRTAAGVDMNSDTTTGDTSQDDTTSETGGSHVPAKVNDVFWERFLTDAAEGKSEAIEAKEDVKTAVDRCCPRLQDNVDQITEQMGQLDSASYAPENY

SEQ ID NO: 592 - protein, 121 aa, Zea mays
MDDRQYAGLTKAGLGVLAFNSGLAIYNSWGDASSVAFVLAADSILVLLFLCLRELELQGRGAAGRGRDVGIIRAAVWTLTTLLSAMFASRVAPLMPPVVGALVWATAVATAAGGFWAVFLS

SEQ ID NO: 593 - protein, 168 aa, Zea mays
MDSKLGVQHGHRHHHSHNGVSKPPVARRRQSGGGGGKGVKVVYISSPMKLTASAEEFRAIVQELTGRDSNVADHDLDGGGAYHVGAPSSTTTTTTSYSSLGRVSPAVAEAAAAAAAGARARSSPATNAGGASPVVEYAAAMAQPPPFQFQGMYDHQIAGSLLYGLDNW

SEQ ID NO: 594 - protein, 339 aa, Zea mays
MSSSSPPPPHVVEDMPHVLQLLSDGTVVRFADYDTLPPPSVPPAPLPVRWKDVVYDATHGLKLRVYSPSPPASCGKLPVLVYFHGGGYVLGTFALPSFHACCLRLAGELPAVVLSADYRLAPEHRLPAALDDAAAVMRWVRAQAVAAGGGDPWLADSADPGRVFVAGDSAGGNIVHHVAVRRLGSAASGELDPVRVAGHVMLCPFFGGAERTASEAEFPPGPFLTLPWYDQAWRLALPPGATRDHPFANPFGPESPALLGLRDVALPPTLVVAAGQDLLRDRQADYVARLKAMGQHVEHVEFEGQHHGFFTVEPASDASSELVRLVKRFVYGDGDGNSI

SEQ ID NO: 595 - protein, 473 aa, Zea mays
MVTGKKRTFVLYPSLGVGHLIPMVELAKHLLRHGHGALIAVVNPPDTDAVSAAAVERLAAANPAIAFRLLPVPASPDAGADWVKRDLDTLRLANPVLRDFLLRSQPAADADALILDMFCVDALDVAAELGVPAYFFFASAAGDLAMFLNLPYLYPTLPSFRDMGEAPVRCPGMPPVRAMDMPLTVQDRDSDRTKVRMYQFRRIPEGRGVLVNSFAWLEPRALRALGDGVCVPGRPTPRVFCVGPLVNDGSSTAGGGGRHECLAWLDAQPKRSVVFLCFGSKGSFPAAQLQEIAHGLESSGHRFLWAVRSPPEEPDTDLGKLLPEGFLDRNRDRGMVVKDWVPQAEVVRHEAVRAFVTHCGWNSTLEAIMSGLPMICWPLYAEQGLNKVFMVEEWRIGVELRGYEKFVKAEELEAKVRLVMEAEEGRILRERLAVAREKALGATKEGGSSEVAFAEFFGDLDKSSSPSVNGECD

SEQ ID NO: 596 - protein, 257 aa, Zea mays
MEHYDSYLCSGSMHSYGGVGGATDAALDAGGDDMQRLLNALMDDMAAESDSFSDDMEAASSESSSSACSANSQQEATRRPQQQPDGGHSNGSNKSSKKQHQQQSPAPYIGVRKRPWGKFAAEIRDSTRKGARVWLGTFDSPEAAAMAYDQAAFSVRGAAAVLNFPVERVQESLRALALSSASSAAGSPVLALKCRHSIRKRSPNKNKNKKQERQQQVAVAAAGPQQPPCPTSVVELEDLGADYLDELLRVSSEFHWQ

SEQ ID NO: 597 - protein, 375 aa, Zea mays
MALIMQESSSHDLLQAHDELLHHSLCFAKSLALAVALDLRIPDAIHHHGAGGATLLQILAETALHPSKLRALRRLMRVLTVTGIFSVEQPPAGGGDNSTVHTSDDEAVVVYRLTAASRFLVSDEVSTATLAPFVSLALQPIAACPHALGISAWFRQEQHEPSPYGLAFRQTPTIWEHADDVNALLNKGMAADSRFLMPIVLRECGETFRGIDSLVDVGGGHGGAAAAIAAAFPHLKCSVLDLPHVVAGAPSDGNVHFVAGNMFESIPPATAVFLKKTLHDWGDDECVKILKNCKQAISPRDAGGKVIILDVVVGYKQSNIKHQETQVMFDLYMMAVNGVERDEQEWKKIFIEAGFKDYKILPVIGDVSVIIEVYP

SEQ ID NO: 598 - protein, 331 aa, Zea mays
MASTGTTAAAVPEVTLRSGNGKPMPMVGMGTASFPVVHEAVRDAVLAAIEVGFRHFDTAFLYGTEKPLGDAVAEALRRGLLRSREELFVTSKLWCSQTHADLVLPSLRETLENLQMEYVDLYLIHWPVCLRPAGGPPKFPNRKEDAVPLDVAGVWRAMEECQRLGLARAIGVSNFTTRHLDKVLAIAAVPPAVNQVELNPAWQQRTLRAYCADRGVHVAAYSPLGGQNWDGRGNAVLDSEVLAEIARARGKTVAQVALRWIHEQGVTCIVKSYNRERLKQNLEIFDWELTDDDRLKISHIPQRKVVEASGLFSQEGEFTSVDPAELNIVEE

SEQ ID NO: 599 - protein, 855 aa, Zea mays
MWSSEMGRRSRRTNGMVAEPQTTQLLLHGVIEATILEADLSVTTDGKLQPTKKTLMKKKVFSWIRKLTFCRNQLENAIGLGTDGKLYATVDIDKARVGRTRMVPPVHSPMWDESFHLYCAHDASNIIFTVKADNAIGATLIGRAYLPTEGVVAGRKVDLWLPIRDEKRQPLEGGDQIHVQVQFTDVAADPTAGWGAGIGSAAYGGVPYTFFKQRRGCRVRLYEDAHVAGDFAPRVRLADGSFYEPRRCWVDVFDAINRARRMVYIAGWSVNTDVVLVRDPREPSASSESLGELLIRKADEGVAVLMLVWDDRTSVGLGPIKRDGLMATHDQDTASFFRDTRVQCVLCPRNPDKDRSYVQDIETATMFTHHQKTVIVDGGGAPAPETPPGLVSFLGGIDLCDGRYDTQDHPLFRTLGTTHSKDFHQPNFPGASISKGGPREPWHDIHCRVEGPAAWDVLENFEQRWKKQGKGDNLLVALNKAWAEREAAPRGDAESWNVQVFRSIDGGAAAGFPEGSANAPREAAALGLVSGKDHVIERSIQDAYIHAIRRARDFIYIENQYFLGSSYAWRQNDGVTVEDINALHLIPKELSLKIVSKIEAGERFVVYVVVPLWPEGVPESGSVQAILDWQRRTMEMMYKDVTLAIRARGLRADPRDYLTFFCLGNREAPSPGEYVPPEHPDPNTDYERAQQARRFMIYVHAKTMIVDDEYIIVGSANINQRSMDGGRDTEIAMGAYQPGYLATRNRPAKGQVHGFRVSLWQEHLGEAAAAGMGDDLFRPSSLACVRRMNQVAKQHWDMFASDAFQGDLPGHLMAYPVSVLDDDDGRVVATTETFPDTNAKVLGNKSDILPPILTT

SEQ ID NO: 600 - protein, 338 aa, Zea mays
MRSTWLAFALSALVVVSSSAAHVHASPGKLEVGFYEHSCAQAEDIVRNAVRRGIAREPGVGAGLIRMHFHDCFVRGCDGSILINSTPGNMAEKDSVANNPSMRGFDVIDDAKAVLEAHCPRTVSCADIVAFAARDSTYLAGGLDYKVPSGRRDGRVSKEEEVLDNNVPAPTDEVDELIESFKRKGLNADDMVTLSGAHTIGRSHCSSFTQRLYNFSGQLGQTDPSLDPAYAGHLKARCPWPSSDDQMDPTVVPLDPVTPATFDNQYYKNVLAHKVLFISDNTLLDNPWTAGMVHFNAAVEKAWQVKFAKAMVKMGKVQVLTGDEGEIREKCFAVNPHY

SEQ ID NO: 601 - protein, 1020 aa, Zea mays
MESYLKENFGGVQAKHSSDEALRRWRKVVGLVKNPKRRFRFTANLDKRNEATAMKRNNHEKLRVAVLVSKAALQFIHSVAPSSEYKVPADVKAAGFGICAEELSSIVEGHDVKKLKSHGGVQGLASKLSTSESDGLTTSADKLATRRDVFGVNKFAEAESRGFLVFVWEALQDMTLMILAACAFFSLIVGIATEGWPKGAHDGLGIVASILLVVFVTASSDYRQSLQFKDLDKEKKKITVQVTRSGYRQKLSIYELLVGDIVHLSIGDQVPADGLFMSGFSLLINESSLTGESEPVAVNVEYPFLLSGTKVQDGSCKMLVTTVGMRTQWGKLMATLSEGGDDETPLQVKLNGVATIIGKIGLIFAVVTFAVLTQSLFRRKIIDGTYLSWTGDDALELLEFFAIAVTIVVVAVPEGLPLAVTLSLAFAMKKMMNDKALVRHLAACETMGSATSICSDKTGTLTTNHMTVVKACICGKIKEVDGVSDIKNLFSELPDSVMAILSQSIFNNTGGDVVLNQDGKREILGTPTETAILEFGLSLGGDFLAVRKASTLVKVEPFNSAKKRMGVVIQLPEGALRAHCKGASEIILASCSKYLNEDGNVIPLDAGTIDHLKATIDSFANEALRTLCLAYIEVEDGFSVNDQIPTDGYTCIGIVGIKDPVRPGVKESVAICRSAGITVRMVTGDNINTAKAIARECGILTEGGIAIEGPDFRTKSEEELTQLIPKIQVMARSSPLDKHTLVKHLRTKLYEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNNELMKRTPVGRKGNFISNIMWRNILGQALYQFLVIWYLQTEGKWLFGIKGDNSDLVLNTLIFNCFVFCQVFNEVSSREMERINVFEGILNNNVFIAVLGSTVIFQFIIIQFLGDFANTTPLTLNQWIACVFIGFIGMPIAAIVKMIPVGST

SEQ ID NO: 602 - protein, 592 aa, Zea mays
MESVKGWVAADYAAEPMASVQHSLRVAYVVFSFCAAFFLGGIKAVVVGPVAAAVMIVGNVGVILVLFPAHVWWAIYSLIKTDRINAGLKLAVLLALPVLFGLWLGLGILGSALVGLGYGFFTPWISTFEAFRQESEAKKFVHGIVDGTWGTIKGSCTVVRDFADICFHSYPVYLKELREGSQNREPHSIRLLDVPSCIVVALLGLVVDIPLYTVIALVKSPYMLFKGWQRLLHDLISREGPFLETVCVPIAGLAILFWPLVVVGSVLLAIVSSIFVGLYGAVIVFQERSFQRGVSYVVAMVAEFDEYTNDWLYLREGTVLPKPSYRKRKPSNSTEFSVRTNASGGKGADHPPGPSEAPAMLVPNLAPARSVREAIQEVKMVQIWENMMKSCEQRGRDLLNQNVITAAGLAEWLRGAKEGGHHETVSLGLPSYSLLCTVLQSIRAGSGGLVLGSFEVNQHNRPQDRLLDWFFHPVLVLKEQIQALRMTEEEVRFLEKLTVFAGNVAGAGAGGWENGAGMMVVPQDPVRLAQIQAISRRLVGIVRSLSKFPTYRRRYRHVVKLLIAYSVERESSGRSSASGRSASYFEITQLDV

SEQ ID NO: 603 - protein, 474 aa, Zea mays
MEKKAATTEEPLLAPRSEHTVAAEAKRLLSLAGPLVASCILQNVVQLVSVMFVGHLGELPLAGASLASSLANVTGFSLLVGMASALDTLCGQAFGARQYGLLGLYKQRAMLVLALACVPIAAVWANAGRILILLGQDRDIAAEAGAYSRWLILSLVPYVPLACHVRFLQTQSIVVPVMASSGATALGHVLVCWALVFKAGMGSKGAALSGAISYSVNLAMLALYVRLSSACKRTWTGFSTEAFRDLLRFTELAVPSAMMVCLEWWSFELLVLLSGLLPNPKLETSVLSICLNTGALLFMVPYGLCTAISTRVSNELGAGEPQAARLAARVVMCIALSAGLLLGSTMILLRSFWGYMYSNEPEVVTYIARMMPVLAISFFTDGLHSCLSGVLTGCGRQKIGARVNLGAYYLAGIPMAVLLAFVLHLNGMGLWLGIVCGSLTKLVLLMWITLRINWEKEATNAKETVFSSSLPVAL

SEQ ID NO: 604 - protein, 264 aa, Zea mays
MAGLFTEQAAVYAAARPAYPKDLFAKLSALTAHHRRAWDVGTGNGQAAIGVAEHYDSVVATDVSAEQLRHATPHPKVRYLHTRDATPGEEDLVAMLGGGEASVDLITVAQAVHWFDLPAFYGAARRVLRRPGGVIAVWGYNYRVSPVEDMMARFFSTTLPYWDPRARYCTDGYRDLPFPFEDIGLGKEGEPASLDVEHEMSFEGLIGMLRSWSAVTTAKQQGVDLLGARVVKELEEGWGGAELVRKVTYKAFLLAGTPGPMADE

SEQ ID NO: 605 - protein, 531 aa, Zea mays
MAVSAAKMAVATAVSLAVHWLLRSFLQAQHPALGLLLPTVVFIGIAASGNAAGAANDAPPGPPAVPVFGNWLQVGNDLNHRFLARLSARYGPVFRLRLGVRNLVVVSDPRLATEVLHTQGVEFGSRPRNVVFDIFTANGADMVFTEYGDHWRRMRRVMTLPFFTARVVQQYRGMWEAEMDAAVSDVASAAQRAAGLVVRRRLQLMLYNIMYGMMFDARFGSVDDPMFVEATRFNSERSRLAQSFDYNYGDFIPVLRPFLRGYLARCKDLQARRLAFFNSNYVEKRRKVMDAPGDKGKLRCAIDHVLQAEKSGEITPENVIYIVENINVAAIETTLWSIEWALAEVVNHPAVQRKVRDEIKAVVADHEPITESTIHRLPYLQAVIKETLRLHSPIPLLVPHMNLEEAKLGGYTIPKGSKVVVNAWWLANNPELWDKPEEFRPERFLGEEKSVDATVGGKVDFRFLPFGVGRRSCPGIILALPILALIVGKLVRSFEMVPPPGVEKLDVSEKGGQFSLHIANHSVIAFHPVSA

SEQ ID NO: 606 - protein, 268 aa, Zea mays
MESSRMRCCMLLVVSLALLLPLGMAADSIGSYCSGSSYAGSSKAVANINSVLADLVASASSTGGYATSTAGKGNNSIIYGLAQCRGDVSASDCASCLADAAKQLPSTCSYSSDARIWYDYCFMRYENANFFGQADTDAGVILVNVQAMDNPKAFEKAVGKVMGKATAQASAAGSAGLGRDKEQYTPFVSIYGLAQCTRDLAPLTCAQCLSTALSRFGDYCGAQQGCQINYSSCRVRYEIYPFYFPLAGKGGGLATTDMTKNTKIVVRP

SEQ ID NO: 607 - protein, 77 aa, Sorghum bicolor
MAASRFYVTCALLLIGVVLLGQQGIEGAVACPQYCLEVDYVTCPSSGSEKLPARCNCCLAPKGCTLHLSDGTQQTCS

SEQ ID NO: 608 - protein, 849 aa, Sorghum bicolor
MPSLSCHNLLDLAAADEVPLPSPTPLRLPRVMSVASPASPTSPSPAAPPRRVIVSHRLPLRASPDPAAPFGFNFSVDSGTVAYQLRSGLPANAPVLHIGTLPAAAAEAASDELSNYLLANFSCLPVYLPTDLHHRFYHGFCKHYLWPLLHYLLPLTPSSLGGLPFQRTLYHSFLSANRAFADRLTEVLSPDEDLVWIHDYHLLALPTFLRKRFPRAKVGFFLHSPFPSSEIFRTIPVRDDLVRALLNADLVGFHTFDYARHFLSACSRLLGLDYQSKRGYIGIEYYGRTVTVKILPVGIDMGQLRSVVSAPETEDVVRRVTETYKGRRLMVGVDDVDLFKGIGLKFLAMEQLLVEHRELRGRAVLVQIANPARSEGRDVQGVQDEARAISARVNARFGTPGYTPIVLIDGPVTPQEKAAYYAAAECCVVSAVRDGLNRIPYIYTVCRQESTALGDDAPKRSVIVLSEFVGCSPSLSGAIRVNPWSVESVAEAMNAALRMSEAEQRLRHEKHYKYVSTHDVAYWARSFDSDLQRACKDHFSRRHWGIGFGMSFKVVALGPNFRRLSVEHIVPSYRRTENRLILLDYDGTVMPENSIDRTPSSEVISVLNRLCEDPKNRVFIVSGRGKDELSRWFAPCEKLGIAAEHGYFTRWSRDAPWEISGLAADFDWKKTAEPVMQLYTEATDGSYIEHKESAIVWHHHEADPDFGSCQAKELLDHLENVLANEPVVVKRGQHIVEVNPQGISKGVVVEGLLSSMVKTGKPPDFVLCIGDDRSDEDMFESIVCPSNSSLKLPASSEVFACTVGKKPSMAKYYLDDTVDVIKMLDGLASAPSQRPRPAVQLRVSFEGSL

SEQ ID NO: 609 - protein, 339 aa, Sorghum bicolor
MGDSKEREPLPRLLDLIPDGKQCKGREAQGAGRSSRNTGFGSEEDKQLELKLGPPGLIEEGTTAAASRGIQREIPALSLGCFPHKPSSKPAINTTATGTKRGFLDTIEAKTEGRDEQKQQAGAGCGKELALDQKITAASERKKGFCPPTSQHAPPPAAATVHDRSHAQGRRSSAPVVGWPPVRSFRRNLAHGSSSKQSIEPQNTEASMKEKLACKKNPLVKINMDGIPIGRKVDLGAYDSYERLSLGVKELFHGFLEAQKDLSSAGSTQPGATEKIFSQLLDGSGEYTLVYQDNEGDRMLVGDVPWNVFVSTAKRLRVLRSSELSHGLIAVAPRRGPDC

SEQ ID NO: 610 - protein, 218 aa, Sorghum bicolor
MAAMWWWAPLPAWLSSSALWFLVVNAVVAAVAVLSRARPPLPSPRRRGSGVTVTRRASSAVMQRLRSLSIFSFPSACFNTTTPLPHPDPDAAQETEEPAAATTTPKTTKPSPSPRALPLPPSPLSSSGRVPPADDDETTGMSMDEAYALALQARRRPEREREEEARRSEVDAKADEFIRGFKEDLRQQRLNSIFNYTQMLKQRALGGAAAARRQPDQL

SEQ ID NO: 611 - protein, 487 aa, Sorghum bicolor
MGSLGSAAQQPHAVCLPYPAQGHITPMLNVAKLLHARGFHVTFVNTEYNQARLVRTRGAAAVAGLPGFRFATIPDGLPPSDDDDVTQDIPSLCKSTTETCLEPFRRLLADLNDSAATGCHPPVTCVVSDVVMGFSIDAAKELGLPYVQLWTASAISFLGYQHYRRLMSRGLAPLKSVEQLTNGFLDTPVEDVPGLRNMRFRDFPSFIRTTDPDEYMVGYVLQETGRSAGASAVIVNTLDELEGEAVAAMESLGLARKVYTLGPLPLLAREDPPTPRSSISLSLWKEQEECLRWLDGRDPGSVVYVNFGSITVMTNEQLVEFAWGLANSGRPFLWIIRRDLVKGDTAVLPPEFLAATADRGLMASWCPQQAVLDHPAVAAFLTHSGWNSTLEAMCGGVPVISWPFFADQQTNCRYQCNEWGVGMEIDSNVRRDAVASLITELMDGERGKEMRRKALEWRDIAVEVAKPGGTSHRNFDDLVRNVLLPKN

SEQ ID NO: 612 - protein, 1241 aa, Sorghum bicolor
MEAAGGAKGRDGVEKKEEENGNGHGGGDAVKKVPFTGLFRYADGTDVLLMLLGTVGSVANGVSQPVMTLIFGQVINAFGDATTDDVLRRVNQAVLNFVYLGIATAVVSFLQVSCWTMTGERQATRIRSLYLKSVLRQEIAFFDVEMTTGQIVSRMSGDTVLVQDAIGEKVGKFQQLVATFVGGFVIAFVKGWLLSLVMLACIPPVVIAGGIVSKMLAKISTKGQASYSDAGNIVEQTLGSIKTVVSFNGEKQAIALYNKLIHKSYKAAVEEGITNGFGMGSVFFIFFSSYGLAIWSLGNATPCMAAFAGGQSAAYRLFTTIKRKPEIDPDDPTGKQLEDIKGDVDLNDVYFSYPARPEQLVFDGFSLHVSSGTTMAIVGESGSGKSTVISLVERFYDPQAGEVLIDGINIKSLQLDWIRGKIGLVNQEPLLFMTSIKDNITYGKEDATIEEIKRAAELANAANFIDKLPNGYDTMVGQRGAQLSGGQKQRIAIARAIIKNPRILLLDEATSALDVESERIVQEALNRIMLDRTTLVVAHRLSTVRNADCISVVQQGKIVEQGPHDELIMNPDGAYSQLIRLQESKEEEQKLDHHMSDSRSKSRSLSLKRSISRGSAGNSSRHSLTLPFGMPGSVELLEGNDANWEDEKDQARDGEAPKKAPMGRLASLNKPEVPILLLGSLAAGVHGVLFPMFGLMISNAIKTFYEPPHQLKKDASFWGLMCVVLGIVSILSIPVEYFLFGIAGGKLIERVRAMSFRSIVHQEVAWFDDPKNSSGALGARLSVDALNVRRLVGDNLALAVQVISTLIAGFVIAFVADWKLTLIILCVMPLSGVQGYAQVKFLKGFSEDAKILYEDASQVATDAVSSIRTVASFSAEKRVTTIYEDKCEASKKQGVRTGMVGGLGFGFSFLMMYLTYGLCFYVGAQFVRHNKSTFGDVFKVFFALMLATIGISQTSALASDSTKAKDSAVSIFALLDRKSKIDSSNDEGSTLHEVKGDIDFRHVSFKYPSRPDIQIFSDFTLHIPAGKTVALVGESGSGKSTVISLLERFYNPDSGTISLDGVEIKSLKVTWLRDQMGLVSQEPILFNDTIRANIAYGKHGEVTEEELIKAAKAANAHEFVSSLPQGYDTTVGERGVQLSGGQKQRVAIARAILKDPRILLLDEATSALDAESERIVQDALDHVMVGRTTVIVAHRLSTIKSADIIAVLKDGVIVEKGRHEALMNIKDGFYASLVELRSASS

SEQ ID NO: 613 - protein, 341 aa, Sorghum bicolor
MAAAASVAPSGPVPFTEVDDGTVPEHTPKEEFGDLVASLPRREQSILELRLYQGFWLPEHWVPGTIVFQRRFTPRPDDVILASYPKCGTTWLKALAFATAARTAYPPSDAGHPLRRMNPHDCIPFIDEIFAGGEDAKLDALPSPRLMNTHLPYALLPASVVTATGGCRVAYVCRDPKDMVVSLWHFLRRTKPDLSFADTFESVCDGTVAAGPVWDHVLSYWRASVATPDRALFLKYEDLLRDPAGNVRRLAEFMGCPFSAAEEAAGNVAAVVELCSFDEMKGLEVNRPGGGTAGKYRAMPRDAFFRKGVAGDWANHMTPEMAARLDQIFRDKLQGTGLAFS

SEQ ID NO: 614 - protein, 261 aa, Sorghum bicolor
MSTPALATAAEGATRIILVHGTGHGGWCWYRVATLLRAAGHRVDAPDMAASGIDSRQLRDVPTFEDYTRPLLDALRALLPGEKAVLVGHSFGGMNIALAAEMFPEKVAAAVFVTAFLPDCTNPRSHVIEKVIGSDWMDTVTDAEHVPPSVFLGPEFLRHKLYQLSPPENYTLSQSLARVSSFYVPDLQSQTPFSESRYGAVRKVYVVCKHDLAITEAYQHTMIAGCPVEEVREIAAADHMPMFSTPAELAGHLAHVANKYA

SEQ ID NO: 615 - protein, 407 aa, Sorghum bicolor
MEEAVEDIVIAGAGLAGLATALGLHRKGVRCLVLESSPTLRASGFAFNTWTNAFRALDALGVGDKIREHHLLYERMIAFSAATGEAAAEVSLKIQGKSGPHEIRCVKRDFLLQTLANELPEGTIRYSSKLAAMEEDDGSVKTLHLADGSIIKAKVVIGCDGVNSVVAKWLGLPKPILSGRSATRGLAEYPAGHGFGPEILQFIGHGFRSGVLPCSDTSVYWNYTWYPSPADGDAEESVAKMRSHVVGKLRGAKIPAEALEVIERSEMSDVASSPLRFRSPLALVRGSISRGGVCVAGDALHPMTPELGQGGCAALEDGVVLARCLGEAFSHGHGHDEQDEGRRFTAALEKYAEARRWRSIQLITAAYVVGFIQQSNNAVIRFLRDKFLSRLLSKTLVAMADYDCGTL

SEQ ID NO: 616 - protein, 491 aa, Sorghum bicolor
MAIKDELQPLHILFFPFLAPGHLIPIADMAALFAARGVKCTILTTPVNAQVIRSAVDHANDASRGTDGALAIDIAVVPFPDVGLPPGVESGPALNSMEDREKFSHAAQLLRDPFDRFLVENRPDAVVSDSFFDWSVDAAAEHGVPRIAFLGISLFARSCSDTMLRNNPVEAAPDDPDAPVLLPGLPHRVELKRSQMMEPKKRPEHWAFFQRVNAADQRSYGEVFNSFHELEPDYLEHYTTTLGRRAWLVGPVALASKDAATRGAGNGLSPDADGCQQWLDTKPEGSVLYVSFGTLSHFSPPELRELARGLDMSGKNFVWVINGGAETEESEWMPDGFAELMACGDRGFIIRGWAPQMVILTHPAVGGFVTHCGWNSTLEAVSAGVPMVTWPRYADQFYNEKLVVELLKVGVGVGSTDYASKLETRRVIGGEVIAEAIGRVMGDGEDAEAIREKAQELGGKARRAVAKGGSSYDDVGRLVDELMARRSSVNV

SEQ ID NO: 617 - protein, 533 aa, Sorghum bicolor
MRATSVHDEYQLVDLCSVFDIIIAAQDWAAKVINQGDGISLSSCDRSAAMAGGGDDAEEITLEHTPTWIVASVCSIIVVISLLFERLLHLLGKRLTKGRRKPLYEALLKVKEELMLLGFISLLLTVFQGTTQKICVQESVMRHLLPCSLPADDKVTAHFMIAGGGTRRLLAGGGASSDYCLKGKVPILSVEAIHQLHIFIFVLAVTHVVLSAVTVILGITQTRNWKYWEDKIQQNNDSAPQMIKHVQEFQFIKSHFRGHGKRWGIFGWLRSFFKQFYGSVTEEDYTTLRLGFVMKHCRGHPKFNFYNYMNRALEVDFKKVVGISWYLWAMLMIFLLLNVHGWYVYIWLSVAPFILLLVLGSKMEHIITELALEVAQKHTAIEGVLVVTPSDELFWFHRPKLVLLLIHIILFQNAFEIALFFWLLVTYGFNSCIMGEPAYAIIRVVISVISQLLCGYSTLPLYALISQMGSSFKKAIFDENISEGLTNWAENARRRNRMATTSVSDNSPIGEGIQMSNKAQRESAMEQGTARLI

SEQ ID NO: 618 - protein, 154 aa, Sorghum bicolor
MSKQKTVIRLGVPNAKNRSKAMQLASKAVGVNSVAIAGEAKDQLEVVGESVDITCLINHLRKKVCRADIVVVEEVKDKKKEEEEKKKKEEEAKKKKAEEDKKKAEEARKKAEEEFKKLWAACPPPPYNGGYYSYPGPPATFVCEEQPAAGCHIM

SEQ ID NO: 619 - protein, 1538 aa, Sorghum bicolor
MALPWWLATTACAAPPPGPGSFADALAFLFLSPCPQRVLLAAADLAFLVACLVLLARRRLRLRRGQGHPAPAAAPAPAPAPEREALLQQKPNHHPSPPLSLRHVLALGASAVFAAASAVLLALALLLLPSAPWRAAEGAFLAVHAVAHGVAAWTVAASSRRAGAAAHLRVFWLATALGAALFAASAVVRGADGSLLFPDDILAFAALLVSLPLPYIAVTTGFTGHGTTRAAQDAEPEHNVPEAPPSSPYAAASFLSRATFSWINSLINKGYAAESLKTEDVPPVSAGHRAEAAHALFMSNWPATSPASRHPVGVALWLSFWPQLVLTAFLGLARLGAMYVGPSLIDRFVEFIRRGGTPWEGLRLVLILLAGKAVQTLASHHYSFQGQLLGMRIRGALQTALYRKSLRLTAGARRAHGAGAIVNYMQVDAGIVSYAMHGLHGLWLMPLQIVVALLLLYAYLGPAVLMTLAVITAVTVVTAFANKLNLAYQLKFLGVRDRRVKAITEMLSNMRVIKLQAWEDTFGGKVRDIRREELGWLAKTMLFMCANTLVFSSGPLAMTVLVFGTYLAAGGQLDAGKVFTATAFFGMLESPMRNFPQTIVMSMQAFVSLDRLNKFLTDAEIDAAAVERIESGGAEDTVAVKVEGGVFAWDVPAGGEMKGNSDRRSSHAVAENGQGNGAELVTVLRGIDVVVRRGELTAVVGKVGSGKSSLLSCFMGEMHKLSGKVSICGSTAYVSQTSWIRNGTIQENILFGKPMRPERYSEIINACCLEKDLEMMEFGDQTEIGERGINLSGGQKQRIQLARAVYQDCDIYLLDDIFSAVDAHTGSAIFMECLKGILKNKTVLLVTHQVDFLQNVDTIIVMNDGLVIQSGIYRELLASCSEFSDLVAAHHSSMETAGGQCFHVQNTESPQASNGSVDSPSLASKSNAENGESVGTATNKEAGSSKLIQEEEKESGRVSWRVYKLYMTEAWGWWGVVIILAVSLLSEGSSMASDYWLSYETSGGPVFDTSIFLGVYVSIVATTIILEMVATLIVTFLGLQSAQAFFNKMFDSILRAPMSFFDTTPSGRILSRASSDQSKIDTNLVFYVGFATSMCISVVTNIAITCQVAWPSVIAVLPLLLLNIWYRNRYIATSRELSRLQGVTRAPIIDHFTETFLGAPTVRCFRKEDEFYQTNLDRINSNLRMSFHNCAANEWLGFRLELIGTLILSITAFLMISLPSNFIKKEFVGMSLSYGLSLNSLVYYAISISCMIENDMVALERVHQYSTLPSEAAWEVADCLPTPDWPIRGDIDVKDLKVRYRQNTPLILKGITVSIKSGEKIGVVGRTGSGKSTLVQALFRILEPAEGHIIIDGVNICTLGLRDLRSRFGVIPQEPVLFEGTVRSNIDPTGRYSEAEIWQALERCQLKDIVASKPEKLDALVADMGENWSVGQKQLLCFGRVILKRSRILFMDEATASVDSQTDAAIQKIIREEFTECTIISIAHRIPTVMDSDRVLVLDSGLVAEFDAPSKLMGRPSLFGAMVQEYASRSSSLKETVG

SEQ ID NO: 620 - protein, 199 aa, Sorghum bicolor
MCGGAIIADFVPAGGRRQATDDTISASSLLSGEDQHLEELGSRVPAPGRKTAYRGIRRRPWGRWAAEIRDPRKGARVWLGTYATPEDAARAYDAAAREIRGAKAKLNFPPAVGAGAGAGAREPAAKRRRTSSSAAAEESSGSSPAATTTVVAGVGGGGGGEETLRDCMSGLEAFLGLQEEAADEGGDAEAWDAVDLMFA

SEQ ID NO: 621 - protein, 107 aa, Sorghum bicolor
MADEEKKHHHHLFHRHKQDGEEEASTGEVDYEKKEKHHKHLEQLGGLGAIAAGAYAIHEKHKAKKEPESAHGHKVKEEVAAVAALGAAGFAFHEHHQKKDAKKQGQS

SEQ ID NO: 622 - protein, 471 aa, Sorghum bicolor
MGSTSTTTTSSSSSATRGGGAHVLLLPYPGAQGHTNPLLEFGRRLAYHGFHPTLVTSRYVLSTTPPPGEPFRVAAISDGFDDGGAAACSDVEVYWRQLEAVGSETLAELIRSEAAEGRPVRVLVYDPHLPWARRVAKAAGVPTAAFLSQPCAVDVVYGEVWAGRLPLPVVDGKELFARGLLGVELGPDEVPPFAAKPDWCPVFLEAWVRQFEGLEDADDVLVNSFHEIEPKEADYMALTWRAKTIGPTLPSFYLDDDRLPLNKSYGFNLFNSSESCLDWLDKQLPCSVVLVSYGTVSDYDEAQLEELGNGLYNSGKPFIWVVRSNEEHKLSNELRAKCKERGLIVSWCSQLEVLAHKATGCFFTHCGWNSTLEAVVNGVPMVAIPHWADQPTISKYMESIWGLGVRVRKDEKGLVTRDEVERCIKDVMDGDRKDNYRMNATMWMQKAKEAMQNGGSSDKNVCEFVAKYSSN

SEQ ID NO: 623 - protein, 86 aa, Sorghum bicolor
MASMMMGGDLVEAYVLKNAYKEKLRRMEAAEETKKGKLGPVAEKKVSGGGSRGGGGLFGLLKKKVHPKAAAASPMETTSAEEATSS

SEQ ID NO: 624 - protein, 173 aa, Sorghum bicolor
MDYGKPLVKSELRLSLNPPPCAQDNNPTTPTGAASDGSSSPSCASAVVALSFLGLNSVVAIYRSRHDPRSILFVTVCFFCVVLLFHLLRVFERLPPGSPRRLPVKAAVWALTTTLTVMFSGRVAPLMPAPVAAVVWSMAAVTILAGFYLFFVCPDAASTAADEKPACKVAEGP

SEQ ID NO: 625 - protein, 326 aa, Triticum aestivum
MASTTAVPEVALRSGDARPMPAIGMGTAKLPVVPETTVKAVLEAVVVGYRHFDTASMYATERPLGEALAEAVRRGLLASREEVFVTSKLWCTQCHPHLVLPSLRESLQNLQMEYVDLYLIHWPISLKPGPAVFPVKREDAVPFDFAGVWRAMEECHRLGLAKAIGVSNFTTSHLHKLLAAATVPPAVNQVEMNPVWQQRKLREYCAEKGIHVAAYSPLGGQNWSGDGNAVLDSEVLAEIAKARGKTVAQVALRWIYEQGATPIVKSFSKERLKENLGIFDWGLTDDDLRKIGQIPQKKIVRAETVLFSAEGEFTSADLAEMEIVEE

SEQ ID NO: 626 - protein, 91 aa, Triticum aestivum
MELEMVSQHGALLKVGLFVLVQALVYLILAQSSSVFSTTKTLCLPPARSLSARRMVALLSDLPLPLGGEPSPRAVFVEPSSPVPLAHQKKD

SEQ ID NO: 627 - protein, 176 aa, Secale cereale
  Sequence also found in Organisms: Triticum aestivum
MASSTALSCLAALLLLAAAAAPASAAEKETRLRVYWHDVVSGGPNARVVQVAQAPSSNASATGFGTVLVIDDPLTEGPNLTSRLLGRAQGMYISAGKDSLSLLMAMNFVFVDGAYNGSSIAIIGPNQADRAVREMPVVGGTGVFRFARGYCQLRTHWFDAKTGDATVEYKIHLRHD

SEQ ID NO: 628 - protein, 263 aa, Triticum aestivum
MSSSSSAPAAAVPTSTRLILVHGTGHGGWCWYKVATLLRAAGHRVDAPDLAACGSDARRLSDAPTFEDYTRPLLDALRDLPDGERAVLVGHSFGGMSIALAAEEFPDKVAAAVFLTAFMPDCDGPRTRVIEEVPVSDWMDSVVDEEHAPPSVFLGPEFVRRKLYQLTSEEDYTLCQSLARVSSYYVADNNNKGGFTAARYGAVTKVYVIAKQDLAMVEEYQRQMIAGIPVAEVREMADADHMAMLSAPEELAGHLADIANNYT

SEQ ID NO: 629 - protein, 196 aa, Triticum aestivum
MGAKLSCFSNHGGSLSQQPHQPAPVRVVAADGSLKELPASPRVTVSDVLGGSAASFFVCSSDALYFEQSPPALASGEVLQSGQIYFVLPAALLGRPLSSAEMASLAVRASSAIAAKKPQRRRGRLSGGRKKVRVMPMHEEVEDGEDVLLNEKLNERTLGEFAVSPMSPEKIGVVAARSRLKMKLKRALSIIQEVAE

SEQ ID NO: 630 - protein, 516 aa, Triticum aestivum
MEMGSFPFFYVAAITFLTALLLRSFLTKKRRRLPPGPALAVPFLGHLPFLKKPLHATLARLAARHGPVFSLRLGSRPAVVVTSAELARECFSSDLDATLANRPHFPSVREVSFDYTVLTLANYGAHWRAARRVAVVHLLSARRVDLMYDAVVARELRALVRRLARLTAGGAAARVELKRRLFDLSHSVLMEALARSRNTYSDDGADMSQEAREMKDVVDAIVPLVGVANLWDYLPVLRWFDWRGVGRQLADVTSRRNAFIYKLIDRERRKQQAAADEHEEEQGMIGVMLSLQKSEPDLYTDTFIAALVANLLGVGTETTSTTTEWAMALLLNHPAVLKKAQEEIDAHLSGEPSRLLDKKDLPHLPYLHCIINETMRLCPAAPLLLPHEAAADCQLHGYDVAAGTIVLVNAYAIHRDPAEWGPAPEEFRPERFEHGGAEGKLMMSFGMGRRKCPGESLAMRTMGMVLGTLIQCFDWKRVGDEEVDMAASSGIVMFKAVALEALCTPRAGMETLLHKL

SEQ ID NO: 631 - protein, 90 aa, Triticum aestivum
MQRSSSFGTSWADQWDTGADPSPRARGGGNGGGDGKKGGVEKTKAAAATGLKKVKAGTAQGFQWIKDKYQKKSAGKSGKQGGGSEVAAGY

SEQ ID NO: 632 - protein, 253 aa, Triticum aestivum
MASYHRVHPVIVDGAPPPVPEQNKDKLPPPPSGAYGDRLPITAPAPGAPAPLKAPRRKRHSRCCRCVCCTLLVLIVLVVALGATAGILYAVFRPKIPTFRVERLTATRFDVNTTSMTVTDAFEVQVITDNPNRRIGVYYDGGWVAASFNGTELCRGAFPALYQGHRSTVRPLITLQGETRLDSAVAAQLAQQRQAGFVPLTVTARVPIRIKFGALKLWTMTGKARCSLVVDSLEAGTRLRIRSNSCTFKLKPN

SEQ ID NO: 633 - protein, 496 aa, Triticum aestivum
MTLSGSGDSQSGSARAHFVLVPMMAQGHTIPMTDMARLLAEHGAQVSFITTPVNAARLEGFAADVKAAGLAVQLVELHFPAAEFGLPDGCENLDMIQSKNLFLNFMEACAALQEPLMAYLREQQRSPPSCIISDMMHWWTGDIARELGIPRLTFSGFCGFSSLVRYIIFHNNVLEHITDDNELITIPGFPTPLEMMKAKLPGTLSVPGMEQIREKMFEEELRCDGEITNSFKELETFYIESFEQITRKKVWTVGPMCLCHRNRNTMAARGNKAAMDDAQCLQWLDSRKPGSVIFVSFGSLACTTPQQLVELGLGLEASKKPFIWVIKAGPKFPEVEEWLADGFEERVKDRGMIIRGWAPQVMILWHQAIGGFVTHCGWNSIIEGICAGVPMITWPHFAEQFLNEKLVVDVLKIGVEVGVKGVTQWGSEKQEVMVTRDAVETAVNTLMDEGEAAEELRVRAKDCAIKARRAFDKEGSSYNNVRLLIQEMGNKTNACG

SEQ ID NO: 634 - protein, 68 aa, Triticum aestivum
MASMMGGDFVEAYVLRNAYKEKLRRMDQAEAAAAQRAPRTPPVPLERRRRLLLAAVVVRAAGEASLAS

SEQ ID NO: 635 - protein, 80 aa, Triticum aestivum
MASAGRRPTVLQQIALFVVVAAVIMNSSVCLGAAGHDATVVGTGSNDPNHPAFPSPPGKPYTGRPCIPKYRCYPPAGGQP

SEQ ID NO: 636 - protein, 350 aa, Zea mays
MAPRQPLLPSFLYAASSGVNGSREAPPVVAGAPSEPLGKIEMFSPAYYAAGALGGAAACGFTHAAVTPLDVIKCNIQIDPAKYKNTSSAFSVVMREQGLRGFFRGWAPTFVGYSAQGAFKYGLYEFFKKTYADMAGPEHAARYKTLIYLAGSATAEVFADVALCPMEAVKVRVQTQPGFARGLSDGFPKIVRAEGYAGLFRGLVPLWGRQIPYTMMKFATYENIVEMTYKHLIPTPKDQCSKPLQLGVSFGSGYVAGVFCAAVSHPADNLVSFLNNAKGATVGDAVKNLGLLGLFTRGLPLRILMVGTLTGAQWVIYDSFKVMIGLPTTGGAPAPATVPMEGLGELKASA

SEQ ID NO: 637 - protein, 490 aa, Zea mays
MGGGNGETTQLGEPLLAKKAKAYRPRCPGCRVDRLNAEREGVFPLKDLFLIWLVTITCTLPIQSLFPFLYFMIRDLHIAKQTQDIGFYAGFVGASYMCGRAVSSTVWGIVADKYGRKPVIVLTLIAIVIFNTMFGLSSNYWMALITRCLLGIMCGYLGPIKAYATEVCRKEYNHLALAVVSSSRGIGLIIGPALGGYLAQPADKYPSIFSQTSIFGRFPYFLPCLCISILAVIALIACIWFPETLHKHNGDAVDNSVETVEESLAGTDTEENGGGGCLKLFTNWPLMSAITLYCIFSLQDVAYAETFSLWAVSDRSFGGLSFTTTDVGNVLAMSGLFLFLYQMLIYPFLAKTVDHITLVRAVALLTLPVLASYPFFPSLSGFGLMVVVNCASFLKNTFSVTTITVFNILMNEAVTQDVRAAANGIAVTLMSISKAVAPAVAGIIFSWAQRRQTAAFLPGDHLVFFILNIFTFIGFVFTFRPFFVRGSAKH

SEQ ID NO: 638 - protein, 228 aa, Zea mays
MAGSAPATAMDKTSFATTCSLLSQYVKEKKGGLLQGLGGLAMAPAAGEEGAFRPPTTMNLLSALDDAPAEERSEKATAGEPKHQDKCTGGNPREEAAGEEEEEAQQLTIFYGGRVVVFDMFPSAKVKDLLQIMSPGGDGVDTAAGATVPTRSLHRPSHDSLSDLPIARRNSLHRFLEKRKDRITARAPYQQVNSSVVGVEASKQAAGAGVEKPWLGLGQEATTAKLEM

SEQ ID NO: 639 - protein, 235 aa, Zea mays
MAASARPGERATSFAVACSLLSRFVRQNGVAAAELGLRIKGEVEQQRTPATTSLLPGAEGEEVERRKETMELFPQSVGFSIKDAAAPPREEQGDKEKPKQLTIFYGGKVLVFDDFPADKAKDLMQLASKGSPVVQNVVLPQPSAAAAVTTDKAVLDPVISLAAAAKKPARTNASDMPIMRKASLHRFLEKRKDRLNAKTPYQTAPSDAAPVKKEPESQPWLGLGPNAVDSSLNLS

SEQ ID NO: 640 - protein, 449 aa, Zea mays
MAGMEGSNSSSQPPPFLIKTYEMVEDPATNHVVSWGPGGASFVVWNPPDFSRDLLPKYFKHNNFSSFIRQLNTYGFRKIDPERWEFANDDFVRGHTHLLKNIHRRKPVHSHSPQTQVNGPLAESERRELEDEISRLKYEKSLLLTDLQRQSQQRCGISWQMQSLERRLAQMEERQRNIVASLRDILLPVGHGVVSWGSATGADHFSKKRRVPKMDFFVDEPKVEEQQVPFLQTVGAETPGMSPIRLLSAEPFEKMELALVSLESFLQRATAHTSAAQGMLYAAGVAEPSPALALGEMLSAPMDTEIDLQPSACQNPFASTSGQDQSSSPLAEPPSYYAQSPMLPMAQLHEHAHRTAAGVDMNSDTTTGDTSQDDTTSETGGSHVPAKVNDVFWERFLTDAAEGKSEAIEAKQDVKTAVDRCCPRLQDNVDQITEQMGQLDSASYAPENY

SEQ ID NO: 641 - protein, 121 aa, Zea mays
MDDRQYAGLTKAGLGVLAFNSGLAIYNSWGDASSVAFVLSADSILVLLFLCLRELELQGRGAAGRGRDVGIIRAAVWTLTTLLSAMFASRVAPLMPPVVGALVWATAVATAAGGFWAVFLS

SEQ ID NO: 642 - protein, 340 aa, Zea mays
MSSSSPPPPHVVEDMPHVLQLLSDGTVVRFADYDTLPPPSVPPAPLPVRWKDVVYDATHGLKLRVYSPSPPASCGKLPVLVYFHGGGYVLGTFALPSFHACCLRLAGELPAVVLSADYRLAPEHRLPAALDDAAAVMRWVRAQAVAAGGGDPWLADSADPGRVFVAGDSAGGNIVHHVAVRRLGSAASGEELDPVRVAGHVMLCPFFGGAERTASEAEFPPGPFLTLPWYDQAWRLTLPTGATRDHPFANPFGPESPALLGLRDVALPPTLVVAAGQDLLRDRQADYVARLKAMGQHVEHVEFEGQHHGFFTVEPASDASSELVRLVKRFVYGDGDGNSI

SEQ ID NO: 643 - protein, 592 aa, Zea mays
MESVKGWVAADYAAEPMASVQHSLRVAYVVFSFCAAFFLGGIKAVVVGPVAAAVMIVGNVGVILVLFPAHVWWAIYSLIKTDRINAGLKLAVLLALPVLFGLWLGLGILGSALVGLGYGFFTPWISTFEAFRQESEAKKFVHGIVDGTWGTIKGSCTVVRDFADICFHSYPVYLKELREGSQNREPHSIRLLDVPSCIVVALLGLVVDIPLYTVIALVKSPYMLFKGWQRLLHDLISREGPFLETVCVPIAGLAILFWPLVVVGSVLLAIVSSIFVGLYGAVIVFQERSFQRGVSYVVAMVAEFDEYTNDWLYLREGTVLPKPSYRKRKPSNSTEFSVRTNASGGKGADHPPGPSEAPAMLVPNLAPARSVREAIQEVKMVQIWENMMKSCEQRGRDLLNQNVITAAGLAEWLRGAKEGGHHETVSLGLPSYSLLCTVLQSIRAGSGGLVLGSFEVNQHNRPQDRLLDWFFHPVLVLKEQIQALRMTEEEVRFLEKLTVFAGNVAGAGAAGWENGAGMMVVPQDPVRLAQIQAISRRLVGIVRSLSKFPTYRRRYRHVVKLLIAYSVERESSGRSSASGRSASYFEITQLDV

SEQ ID NO: 644 - protein, 531 aa, Zea mays
MAVSAAKMAVATAVSLAVHWLLRSFLQAQHPALGLLLPTVVFIGIAASGNAAGAANDAPPGPPAVPVFGNWLQVGNDLNHRFLARLSARYGPVFRLRLGVRNLVVVSDPRLATEVLHTQGVEFGSRPRNVVFDIFTANGADMVFTEYGDHWRRMRRVMTLPFFTARVVQQYRGMWEAEMDAAVSDVASAAQRAAGLVVRRRLQLMLYNIMYGMMFDARFGSVDDPMFVEATRFNSERSRLAQSFDYNYGDFIPVLRPFLRGYLARCKDLQARRLAFFNSNYVEKRRKVMDAPGDKGKLRCAIDHVLQAEKSGEITPENVIYIVENINVAAIETTLWSIEWALAEVVNHPAVQRKVRDEIKAVVADHEPITESTIHRLPYLQAVIKETLRLHSPIPLLVPHMNLEEAKLGGYTIPKGSKVVVNAWWLANNPELWDKPEEFRPERFLGEEKSVDATVGGKVDFRFLPFGVGRRSCPGIILALPILALIVGKLVRSFQMVPPPGVEKLDVSEKGGQFSLHIANHSVIAFHPVSA

SEQ ID NO: 645 - protein, 339 aa, Sorghum bicolor
MGDSKEREPLPRLLDLIPDGKQCKGREAQGAGRSSRNTGFGSEEDKQLELKLGPPGLIEEGTTAAASRGIQREIPALSLGCFPHKPSSKPAINTTATGTKRGFLDTIEAKTEGRDEQKQQAGAGCGKELALDEKITAASERKKGFCPPTSQHAPPPAAATVHNRPHAQGRRSSAPVVGWPPVRSFRRNLAHGSSSKQSIEPQNTEASMKEKLACKKNPLVKINMDGIPIGRKVDLGAYDSYERLSLGVKELFHGFLEAQKDLSSAGSTQPGATEKIFSQLLDGSGEYTLVYQDNEGDRMLVGDVPWNVFVSTAKRLRVLRSSELSHGLIAVAPRRGPDC

SEQ ID NO: 646 - protein, 344 aa, Sorghum bicolor
MAAAAAAASVAPSGPVPFTEVDDGTVPEHTPKEEFGDLVASLPRREQSILELRLYQGFWLPEHWVPGTIVFQRRFTPRPDDVILASYPKCGTTWLKALAFATAARTAYPPSDAGHPLRRMNPHDCIPFIDEIFAGGEDAKLDALPSPRLMNTHLPYALLPASVVTATGGCRVAYVCRDPKDMVVSLWHFLRRTKPDLSFADTFESVCDGTVAAGPVWDHVLSYWRASVATPDRALFLKYEDLLRDPAGNVRRLAEFMGCPFSAAEEAAGNVAAVVELCSFDEMKGLEVNRPGGGTAGKYRAMPRDAFFRKGVAGDWANHMTPEMAARLDQIFRDKLQGTGLAFS

SEQ ID NO: 647 - protein, 491 aa, Sorghum bicolor
MAIKDELQPLHILFFPFLAPGHLIPIADMAALFAARGVKCTILTTPVNAQVIRSAVDHANDASRGTEGALAIDIAVVPFPDVGLPPGVESGPALNSMEDREKFSHAAQLLRDPFDRFLVENRPDAVVSDSFFDWSVDAAAEHGVPRIAFLGISLFARSCSDTMLRNNPVEAAPDDPDAPVLLPGLPHRVELKRSQMMEPKKRPEHWAFFQRVNAADQRSYGEVFNSFHELEPDYLEHYTTTLGRRAWLVGPVALASKDAATRGAGNGLSPDADGCQQWLDTKPEGSVLYVSFGTLSHFSPPELRELARGLDMSGKNFVWVINGGAETEESEWMPDGFAELMACGDRGFIIRGWAPQMLILTHPAVGGFVTHCGWNSTLEAVSAGVPMVTWPRYADQFYNEKLVVELLKVGVGVGSTDYASKLETRRVIGGEVIAEAIGRVMGDGEDAEAIREKAQELGKKARRAVAKGGSSYDDVGRLVDELMARRSSVNV

SEQ ID NO: 648 - protein, 471 aa, Sorghum bicolor
MGSTSTTTTSSSSSATRGGGAHVLLLPYPGAQGHTNPLLEFGRRLAYHGFHPTLVTSRYVLSTTPPPGEPFRVAAISDGFDDGGAAACSDVEVYWRQLEAVGSETLAELIRSEAAEGRPVRVLVYDPHLPWARRVAKAAGVPTAAFLSQPCAVDVVYGEVWAGRLPLPVVDGKELFARGLLGVELGPDEVPPFAAKPDWCPVFLEACTRQFEGLEDADDVLVNSFHEIEPKEADYMALTWRAKTIGPTLPSFYLDDDRLPLNKSYGFNLFNSSESCLDWLDKQLPCSVVLVSYGTVSDYDEAQLEELGNGLYNSGKPFIWVVRSNEEHKLSNELRAKCKERGLIVSWCSQLEVLAHKATGCFFTHCGWNSTLEAVVNGVPMVAIPHWADQPTISKYMESIWGLGVRVRKDEKGLVTRDEVERCIKDVMDGDRKDNYRMNATMWMQKAKEAMQNGGSSDKNVCEFVAKYSSN

SEQ ID NO: 649 - protein, 91 aa, Aegilops tauschii
  Sequence also found in Organisms: Triticum aestivum
MELEMVSQHGALLKVGLFVLVQALVYLILAQSSSVFSTTKTLCLPPARSLSARRMVALLSDLPLPLGGEPSPRAAFVEPPSPVPLAHQKKD

SEQ ID NO: 650 - protein, 175 aa, Triticum aestivum
MASSTALSCLAALLLLAAAAAPASAAEETRLRVYWHDVVSGGPNARVVQVAQAPSSNASATGFGTVLVIDDPLTEGPNLTSRLLGRAQGMYISAGKDSLSLLMAMNFVFVDGAYNGSSIAIIGPNQADRAVREMPVVGGTGVFRFARGYCQLRTHWFDAKTGDATVEYKIHLRHD

SEQ ID NO: 651 - protein, 196 aa, Triticum aestivum
MGAKLSCFSNRGGSLSQQPHQPAPVRVIAADGSLKELPASPRVTVSNVLGGSAASFFVCSSDALYFDQSPPALASGEVLQSGQIYFVLPAALLGRPLSSAEMASLAVRASSAIAAKKPQRRRGRLSGGRKKVRVMPMHEEVEDGEDVLLNEKLNERTLGEFAVSPMSPEKIGVVAARSRLKMKLKRALSIIQEVAE

SEQ ID NO: 652 - protein, 516 aa, Triticum aestivum
MEMGSFPFFYVAAITFLTALLLRSFLTKKRRRLPPGPALAVPFLGHLPFLKKPLHATLARLAARHGPVFSLRLGSRPAVVVTSAELARECFSSDLDATIANRPHFPSVREVSFDYTVLTLANYGAHWRAARRVAVVHLLSARRVDLMYDAVVARELRALVRRLARLTAGGAAARVELKRRLFDLSHSVLMEALARSRNTYSDDGADMSQEAREMKDVVDAIVPLVGVANLWDYLPVLRWFDWRGVGRQLADVTSRRNAFIYKLIDRERRKQQAAADKQEEEQGMIGVMLSLQKSEPDLYTDNFIAALVANLLGVGTETTSTTTEWAMALLLNHPAVLKKAQEEIDAHLSGEPSRLLDKKDLPHLPYLHCIINETMRLCPAAPLLLPHEAAADCQLHGYDVAAGTIVLVNAYAIHRDPAEWGPAPEEFRPERFEHGGAEGKLMMSFGMGRRKCPGESLAMRTMGMVLGTLIQCFDWKRVGDEEVDMAASSGIVMFKAVALEALCTPRAGMETLLHKL

SEQ ID NO: 653 - protein, 253 aa, Triticum aestivum
MASYHRVHPVIVDGAPPPVPEQNKDKLPRPPSADYGDRLPITAPAPGAAAPLRAPRRKRHNRCCRCVCCTLLVLIVLIVALGATAGILYAVFRPKIPTFRVERLTATRFDVNTTSMTVSDAFEVQVVAENPNRRIGVYYDGGWVAASFNGTELCRGAFPALYQGHRSTVRPLITLQGETRLDSAVAAQLAQQRQAGFVPLTVTARVPIRIKFGALKLWKMTGKATCSLVVDSLEAGTRLRIRSNSCTFKLKPN

SEQ ID NO: 654 - protein, 81 aa, Triticum aestivum
MASAGRRPTVLMQIALFFVVAAVIMNSSVCLGAAAGDATAGSGAFDPNRPAVPSTGGAGKPYTGRRCLPKYRCYPPAGGQP

SEQ ID NO: 655 - protein, 357 aa, Secale cereale
MASSSSSLAGLAVLLTAVLCLQLPVHSRAQLRVGFYNTTCPNAEAIVRQAVTAAFATNPGVAAGLIRLHFHDCFVEGCDSSVLLSVNPGGGKTEREAAPNNPSLRGFAVVDAARAALEQSCPRTVSCADILAFAARDSVNITGSNAFYQVPSGRRDGNLSTEGGAFTLPGPNLTADGLVSGFEIRGLTAEDMVVLSGSHTLGRSHCNSFIVRNRERLASGTISPAYQALLEALCPANTSQFTNVTTEIDLSTPVVLDNNYYKLVQLNLGLHFSDDQLIRNATLKAFVDTFAANETLWKEKFIAAMIKMGNIAPKTGTQGEIRLNCSIVNPSSSSSSAYAGVIEMLRRPGSDDKVAMG

SEQ ID NO: 656 - protein, 356 aa, Triticum aestivum
MASSGGLAGLAVLLTAVLCLQLPVHSRAQLRVGFYNTTCPNAEAIVRQAVTAAFATNPGVAAGLIRLHFHDCFVEGCDSSVLLSVNPGGGTTEREAAPNNPSLRGFAVVDAARAALEQSCPRTVSCADILAFAARDSVNITGSNAFYQVPSGRRDGNLSTDTGAFTLPGPNLTADGLVRGFADRNLTAEDMVVLSGSHTLGRSHCNSFIVRNRERLASGTISPAYQALLEALCPANTSQFTNVTTEIDLSTPVVLDNNYYKLVQLNLGLHFSDDQLIRNATLKAFVDAFAANETLWKDKFLAAMIKMGNISPKTGTQGEIRLNCSLVNPASSSSSAYAGVIEMLRRQGSDDKVAKG

SEQ ID NO: 657 - protein, 356 aa, Secale cereale
MAGSSGLTGLAVLLTAVLCLQLPVHSRAQLRVGFYNTTCPNAEAIVRQAVTAAFATNPGVAAGLIRLHFHDCFVEGCDSSVLLSVNPGGGKTEREAAPNNPSLRGFGVVDAARAALEQSCPRTVSCADILAFAARDSVNITGSNAFYQVPSGRRDGNLSTEGGAFTLPGPNLTADGLVSGFETRGLTAEDMVVLSGSHTLGRSHCNSFIVRNRERLASGTISPAYQALLEALCPANTSQFTNVTTEIDLSTPVVLDNNYYKLVQLNLGLHFSDDQLIRNATLKAFVDTFAANETLWKEKFIAAMIKMGNIAPKTGTQGEIRLNCSIVNPSSSSSSAYAGVIEMLRRPGSDGKVAMG

SEQ ID NO: 658 - protein, 355 aa, Triticum aestivum
MASSSSSLAGLLLTAVLCLQLPVHSRAQLRVGFYNTTCPNAEAIVRQAVTAAFATNSGVAAGLIRLHFHDCFVEGCDSSVLLSVNPGGGTPERDAAPNNPSLRGFALVDAARAALEQSCPRTVSCADILAFAARDSVNITGSNAFYQVPSGRRDGNLSTEAGAFTLPGPNLTADGLVSGFRDRGLTAEDMVVLSGSHTLGRSHCNSFIVRNRERLASGTISPAYQALLEALCPANTSQFTNVTTEIDLSTPVVLDNNYYKLVQLNLGLHFSDDQLIRNATLKGFVDAFAANETLWKEKFIAAMIKMGNIAPKTGTQGEIRLNCSIVNPSSSSSSGYAGVIEMLRRPGSDDKLAMG

SEQ ID NO: 659 - protein, 276 aa, Hordeum vulgare
MAPSSSSPLPASPLLVLLMVPLLLAMARPCSGVDAIGTYCAKNGTSAETQASIDQVLAALVPRASAAYYATATAGRSSSAVWGLAQCRGDVPRQDCSLCLAAAAKEVASSCRGSSDGRVFYDYCLLRYSTANFIGLADTGYTLILLNTQNATGVDLAAFDRAQGKLMSRVASEAGDAANKGLATDTTRLGSDGGGAKTTIYGLGWCTRDITAADCGLCVAQAVAELPNYCRYRRGCRVIYSSCMARYEVYPFFFPLDGTDKSADEVGQCDKIVLNA

SEQ ID NO: 660 - protein, 294 aa, Aegilops tauschii
MHANKSLVAAIATHITSKRRHAMASSSSSPLLMLLLLPLLLAMARPCSAVDAIGTYCAKNGTSAETQASIDRVLAALVPRASAAYYAPATAGRSSSAVWGLAQCRGDVPRQDCSLCLAAAAQEVASSCRGSSDGRVFYDYCLLRYSTSNFVGLADTGYTLILLNTQNATGVDLAAFDRAQGKLMSRVASEAGDAANKGLATDTTRLGSEGGGAKTTIYGLGWCTRDITAADCGLCVAQAVAELPNYCRYRRGCRVIYSSCMARYEVYPFFFPLDGADESADELGQCDKIVLNYP

SEQ ID NO: 661 - protein, 272 aa, Triticum aestivum
MASSSSSPLLMLLLLPLLLAMARPCSAVDAIGTYCAKNGTSAETQASIDQVLAALVPRASAAYYATATAGRSSSAVWGLAQCRGDVPRQDCSLCLAAAAKEVASSCRGSSDGRVFYDYCLLRYSTSNFIGLADTGYTLILLNTQNATGVDLAAFDRAQGKLMSRVASEAGDAANKGLATDTTRLGSDGGGAKTTIYGLGWCTRDITAADCGLCVAQAVAELPNYCRYRRGCRVIYSSCMARYEVYPFFFPLDGAGESADEVGQCDKIVLNYP

SEQ ID NO: 662 - protein, 275 aa, Aegilops tauschii
MQQAMASSSSSPLLMLLLVPLLLAMARPCSGVDAISTYCAKNGTSAQTQASIDQVLTALVPRASAAYYATATAGRSSSAVWGLAQCRGDVPRQDCSLCLAAAAKEVASSCRGSSDGRVFYDYCLLRYSSSNFIGLADTGYTLILLNTQNATGVDLAAFDRAQGKLMSRVASEARDTANKGLATDTTRLGGGGGGAKTTIYGLGWCTRDITAADSGLCVAQAVAELPNYCRYRRGCRVIYSSCMARYEVYPFFFPLGGARESADEVGQCDKIVLNA

SEQ ID NO: 663 - protein, 271 aa, Leymus cinereus x Leymus triticoides
MASSSSSPQLMLLLLPLLLAMARPCSGVDAIGTYCAKNGTSAETQASIDEVLAALVPRASAAYYATATAGRSSSAIWGLAQCRGDVPRQDCSLCLAAAAKEVASSCRGSADGRVFYDYCLLRYSSSNFVGLADTGYTLILLNTQNATGVDLAAFDRAQGKLMSRVASEAGDAANKGLATDTTRLGGGGGRAKTTIYGLGWCTRDITAADCGLCVAQAVAELPNYCRYRRGCRVIYSSCMARYEVYPFFFPLGGAGESADEVGECDKIVLNA

SEQ ID NO: 664 - protein, 475 aa, Secale cereale
METTVTAATATTSSSVGHGAGGGAARVLLLPVPGAQGHTNPMLQLGRRLAYHGLRPTLVATRYVLSTTPPPGEPFGVAAISDGFDAGGMASCPDMAEYFSRLAAVGSETLRELLLSEARAGRPVRVLVYDAHLAWARRVAQASGVAAAAFFSQPCAVDIVYGELWAGRLALPATDGRALLARGALGVELGLEDMPPFAAVPESQPTFLKVSVGQFEGLEDADDVLVNSFRDLEPKEVEYLELTWRAKMVGPTLPSFYLDDDRLPSNKSYGFDLFNSDALCMDWLEKQSNSSVVLVSYGTVSNYDATQLEELGNGLCNSGKPFLWVVRSNEEHKLSKELKEKCEKIGLIVSWCPQLEVLAHRAIGCFVTHCGWNSTLEALVNGVPLVGIPHWADQPTIAKYMESAWSMGVRVQKDDNGCLKMEEVERCIREVMDAERNDEYKKNIVKWMQKAKEAMQEGGSSDKNIAEFATKYSSI

SEQ ID NO: 665 - protein, 475 aa, Triticum aestivum
METTVPAATATTSSSVGHGAGGGAARVLLLPYPGAQGHTNPMLQLGRRLAYHGLRPTLVATRYVLSTTPPPGAPFGVAAISDGCDAGGMASCPDMAEYVSRLAAVGSETLRELLLSEARAGRPVRVLVYDAHLAWARRVAQASGVAAAAFFSQPCAVDVVYGELWAGRLALPATDGRALLARGALGVELGPEDMPPFAAVPESQPTFLKVSVGQFEGLEDADDVLVNSFRDLEPKEVEYMELTWRAKMVGPTLPSFYLNDDRLPSNKSYGFNFFNGDALCMDWLEKQSNSSVVLVSYGTVSNYDATQLEELGNGLCNSGKPFLWVVRSNEEHKLSKELKEKCEKIGLIVSWCPQLEVLAHRAIACFVTHCGWNSTLEALVNGVPLVGIPHWADQPTIAKYMESAWSMGVRVRKDNNGYLKMEEVERCIREVMDVERKDEYKRNVVKWMQKAKEAMREGGSSDKNIAEFATKYSSI

SEQ ID NO: 666 - protein, 468 aa, Secale cereale
AAGSTPARASATGGAVLRRVLLLPVPGAQGHTNPMLQLGRRLAYHGLRPTLVATRYVLSTTPAPGEPFGVAAISDGFDAGGMASCPDMAEYFSRLAAVGSETLRELLLSEARAGRPVRVLVYDAHLAWARRVAQASGVAAAAFFSQPCAVDVVYGELWAGRLALPATDGRALLARGALGVELGPEDMPPFAAVPESQPVFLKVLVGQFEGLEDADDVLVNSFRDLEPKEVEYMELTWRAKMVGPTLPSFYLDDDRLPSNKSYGFDLFNSDALCMDWLEKQSNSSVVLVSYGTVSNYDATQLEELGNGLCNSGKPFLWVVRSNEEHKLSKELKEKCEKIGLIVSWCPQLEVLAHRAIGCFVTHCGWNSTLEALVNGVPLVGIPHWADQPTIAKYVESAWSMGVRVRKDDNGCLKMEEVERCIREVMDAERKDEYKRNAVKWMLKSKKAMQEGGSSDKNIAEFAIKYSSI

SEQ ID NO: 667 - protein, 230 aa, Aegilops tauschii
MEGAGSGGKMGGGEGMAGRAGAGAASAAKEKSGFAATCSLLSRYMKEKKGGALQGLVGLDMSPPAAVVVGEGAFQPPTTMNLLSGLEEPNAADVELRLEKSSVGQFLKATTDNQDAGEDAHQLTIFYGGKVVVVDNFPSTKVKDLLQMADGAGDKTGSSSLAQQSPPQPAQNALPDLPIARRNSLHRFLEKRKGRIVAKAPYQINSSSAAPSKQANGDNSWLGLGQEVTN

SEQ ID NO: 668 - protein, 215 aa, Triticum aestivum
MAGRAGAGAASAAKEKSGFAATCSLLSRYMKEKKGGALQGLVGLDMSPPAAVVVGEGAFQPPTTMNLLSGLEEPNAADVELPLEKSSVGQFLKATTDNQDAGEDAHQLTIFYGGKVVVVDNFPSTKVKDLLQMADGAGDKTGSSSLAQQSPPQPAQNALPDLPIARRNSLHRFLEKRKGRIVAKAPYQINSSSAAPSKQANGDNSWLGLGQEVTN

SEQ ID NO: 669 - protein, 214 aa, Secale cereale
MAGRAGAGAAAAKEKSGFAATCSLLSRYMKEKKGGALQGLLGLDMAPPAAVGDEGGSFQPPTTMNLLSGLEEPNTTDVELPLEKSSAGQFLKATTDNQDAREDAHQLTIFYGGKVVVVDNFPSTKVRDLLQMADGAGDKAGSSSLVQQSPPQPAHNTLPDLPIARRNSLHRFLEKRKGRIVAKAPYQINSASTAPSKQANGDNSWLGLGQEVTN

SEQ ID NO: 670 - protein, 215 aa, Triticum aestivum
MAGRAGAGAAAAAKEKSGFAATCSLLSRYMKEKKSGALQGLVGLDMSPPAAVVGEEGAFQPPTTMNLLSGLEEPNAADVEFPLEKSSVGQFLKATTDNQDAGQDAHQLTIFYGGKVVVVDNFPSTKVKDLFKMANGAGDKAGSSSLVQQSPPQPAHNTLPDLPIARRNSLHRFLEKRKGRIVAKAPYQINGSSAAPSKQANGDNSWLGLGQEVTN

SEQ ID NO: 671 - protein, 312 aa, Aegilops tauschii
  Sequence also found in Organisms: Triticum aestivum
MAAKTTSCFTFLKEALVLPTRNPKLFAPILIFVAAIAFLIPAVNVVFIQPLTAEMLHHVAEMQTTDPSSAEYARLLEEIRQEARELVLIAVALTVVTLPLVFAKQILAFSAASTTYSGDRYSLAELLRRVTKWANLRGPLVTVGVVTALQLTFMALLGVYLSAVMRHAGVLSVQGAVFVLAFLAFMYFGVVAVVGVAVSVADEGCRGVRALGRAWRLMTRVRRKEGALLAAVMVLLPTVVSPVYALALTYARKSMAVGLYLLFGYALLSAAVQVFYIAAATVYYYEAMESKEVVVTFHGYAKIPSGEGEANV

SEQ ID NO: 672 - protein, 313 aa, Triticum aestivum
MAAKTTSCFTFLKEALVLPTRNPKLFAPILILLAIIAFLVPAVNVVLIQPLTAQMLRHLTEMQTTDPSSAEFARLLEEIRQEARELVLISVGLFFVTLALVFAKQILAFSAASTTYSGDRYSLAELLRRVTKWGNLRGPLVTVGVVTALQLTFMALLGAYLSTVMRHAEALSVQGALFALAFLAFMYFGVVAVVGVAVSVADEGCRGVRALLRAWRLMMRVSRKEGALLAAVMLLLSTVVSPVYALALVYAKKSMAVGLCLLFGYALLSAAVELFYMAAATVYYYEAMESKEAILAFDGYYAKIPSGEGEANV

SEQ ID NO: 673 - protein, 310 aa, Leymus cinereus x Leymus triticoides
MAAKTTSPFTFLKEALVLPTRNPKLFAPILILLAVIAFLVPAVNVVSIQPLTAEMVRHLTEMQTTDPSSAEYARLLEEIRQEARELVLIAVGLSLVTLALVFAKQIVAFSGASTTYSGERYSLAELLRWVTKWGNLKGPLVTVAVVTALQLTFMALLGVYLSTVMRHAEVLSVQGVLFVLAFLAFMYFGVVAVVGVAVSVADERCRGVRALRRAWRLMTQVSRKEGALLAAVMVLLPTVLSPLYGLALVYAQKSMAVGLCLLFGYALLSGVVELFYIAAATVYYYEAMESKEAVVAFDGYAKIPSGEANV

SEQ ID NO: 674 - protein, 530 aa, Triticum aestivum
MNLESVLSPAALPWSYLACGLLSLALLVLWPTTRLLEQLWWRPRRLERALRAQGLRGTSYSFLLGDMSDYGRQNKEAWSKPLPLRCHDIGAHVMPFLYRTVQEHGKQCISWFGPVPKVSITDPNLVREVMSNKFGHIQKVKFPALSKLLAVGVATHEGEKWVKHRRILNPAFHVEKLKIMLPAFSLCCEELVNKWTQSLGPDGSCEVDVSLELQSLTGDVISRTAFGSSYLEGRRIFQLQSEQVGRFMAAIHKIMIPGYMSFPTKNNRRMRQINNEIESILRGLIGKRMQAMQGESTNDDLLGLLLESNKTDMNENGQSIPGMSIEEVIEECKLFYFAGMETTSILLTWTMVVLSMHPEWQDRAREEVLGLFGKHKLDYEGLNRLKTVTMILYEVLRLYPPASAFTRQTYKEIEIGGVTYPPGVIFEMSVLHIHHDKDIWGDDVHQFRPDRFAEGISKASKEPGGFFPFGWGPRICIGQNFALLEAKMALCMILRRFEFELAPSYTHAPHTVMMLRPMHGAQIKLQATSS

SEQ ID NO: 675 - protein, 519 aa, Triticum aestivum
ALPWSYLACGLLGLALLWPTTRLLDQLWWRPRRLERALRAQGLRGTSYSFLLGDMSDYGRQNKEAWSKPLPLRCHDIGAHVLPFLYSTVEEHGKQCISWFGPVPKVSITDPNLVREIMSNKFGHIQKVKFPALSKLLAVGVATHEGEKWVKHRRILNPAFHVEKLKIMLPAFSLCCEELVNKWAQSLGPDGSCEVDASLELQSLTGDVISRTAFGSSYLEGRRIFQLQSEQVGRFMAAIHKIMIPGYMSFPTKNNRRMRQINNEIESILRGLIGKRMQAMQEGESTNDDLLGLLLESNKTDVNENGQSVPGMSTEEVIEECKLFYFAGMETTSILLTWTMVVLSMHPEWQDRAREEVLGLFGKHKLDYEGLNRLKTVTMILYEVLRLYPPASAFTRQTYKEIEIRGIRYPPGVIFEMSVLHIHHDKDIWGDDVHQFRPDRFAEGISKASKEPGAFFPFGWGPRICIGQNFALLEAKMALCMILRRFEFELAPSYTHAPHTVMMLRPMHGAQIKLRAISS

SEQ ID NO: 676 - protein, 530 aa, Secale cereale
MNPESVLMTPAALPWSYLACGLLGLALLWPTTRLLDRLWWRPRRLERALRAKGLRGTSYRFLLGDMSDYGRQNKEAWSKPLPLRCHDIGAHVMPFLYSTVQQHGRRCISWFGPVPKVSITDPSLVREIMSNKFGHIHKVKFPALAKLLAIGVATHEGEKWVKHRRILNPAFHAEKLKIMLPAFSLCCEELVNKWTRSLGPDGSCEVDASLELQSLTGDVISRTAFGSSYLEGRRIFQLQSEQVGRFMAAIHKIMIPGYMSFPTKNNRRMRQINNEIESILRGLIGKRMQAMQEGESTYDDLLGLLLESNKTDMNENGQSIPGMSIEDVIEECKLFYFAGMETTSILLTWTMVVLSMHPEWQDRAREEVLGLFGKHKLDYEGLNRLKTVTMILYEVLRLYPPASAFTRQTYKEIEIGGVTYPPGVIFEMSVLHIHHDKDIWGDDVHQFRPDRFAEGISKASKEPGAFFPFGWGPRICIGQNFALLEAKMALCMILQRFEFELAPSYTHAPHTVMMLRPMHGAQITLRPISS

SEQ ID NO: 677 - protein, 529 aa, Secale cereale
MNPESVLTPAALPWSYLACGLLGLALLWPTTRLLDRLWWRPRRLERALRAKGLRGTSYRFLLGDMSDYGRQNKEAWSKPLSLRCHDIGAHVMPFLYSTVQQHGRRCISWFGPVPKVSITDPNLVREIMSNKFGHIHKVKFPALAKLLAIGVATHEGEKWVRHRRILNPAFHVEKLKIMLPAFSLCCEELVNKWTRSLGPDGSCDVDASLELQSLTGDVISRTAFGSSYLEGRRIFQLQSEQVGRFMAAIHKIMIPGYMSFPTKNNRRMRQINNEIESILRGLIGKRMQAMQEGESTYDDLLGLLLESNKTNMNENGQSIPGMSIEDVIEECKLFYFAGMETTSILLTWTMVVLSMHPEWQDRAREEVLGLFGKHKLEYEGLNRLKTVTMILYEVLRLYPPASAFTRQTYKEIEIGGVTYPPGVIFEMSVLHIHHDKDIWGDDVHQFRPDRFAEGISKASKEPGAFFPFGWGPRICIGQNFALLEAKMALCMILQRFEFELAPAYTHAPHTVMMLRPMHGAQIKLRAISS

SEQ ID NO: 678 - protein, 522 aa, Secale cereale
TPAALPWSYLACGLLGLALLWPTTRLLDRLWWRPRRLERALRAKGLRGTSYRFLLGDMSDYGRQNKEAWSKPLPLRCHDIGAHVMPFLYSTVQQHGRRCISWFGPVPKVSITDPNLVREIMSNKFGHIHKVKFPALAKLLAIGVATHEGEKWVRHRRILNPAFHVEKLKIMLPAFSLCCEELVNKWTRSLGPDGSCEVDASLELQSLTGDVISRTAFGSSYLEGRRIFQLQSEQVGRFMAAIHKIMIPGYMSFPTKNNRRMRQINNEIESILRGLIGKRMQAMQEGESKNDDLLGLLLESNKTNMNENGQSIPGMSIEDVIEECKLFYFAGMETTSILLTWTMVVLSMHPEWQDRAREEVLGLFGKHKLDYEGLNRLKTVTMILYEVLRLYPPASAFTRQTYKEIEIGGITYPPGVIFEMSVLHIHHDKDIWGDDVHQFRPDRFAEGISKASKEPGAFFPFGWGPRICIGQNFALLEAKMALCMILQRFEFELAPAYTHAPHTVMMLRPMHGAQIKLHAISS

SEQ ID NO: 679 - protein, 547 aa, Aegilops tauschii
MPIQSIPISKHAHEREAMNLESVLSPAALPWSYLACGLLSLALLVLWPTTRLLEQLWWRPRRLERALRAQGLRGTSYSFLLGDMSDYGRQNKEAWSKPLPLRCHDIGAHVMPFLYRTVQEHGKQCISWFGPVPKVSITDPNLVREVMSNKFGHIQKVKFPALSKLLAVGVATHEGEKWVKHRRILNPAFHVEKLKIMLPAFSLCCEELVNKWTQSLGPDGSCEVDVSLELQSLTGDVISRTAFGSSYLEGRRIFQLQSEQVGRFMAAIHKIMIPGYMSFPTKNNRRMRQINNEIESILRGLIGKRMQAMQGESTNDDLLGLLLESNKTDMNENGQSIPGMSIEEVIEECKLFYFAGMETTSILLTWTMVVLSMHPEWQDRAREEVLGLFGKHKLDYEGLNRLKTVTMILYEVLRLYPPASAFTRQTYKEIEIGGVTYPPGVIFEMSVLHIHHDKDIWGDDVHQFRPDRFAEGISKASKEPGAFFPFGWGPRICIGQNFALLEAKMALCMILRRFEFELAPSYTHAPHTVMMLRPMHGAQIKLQATSS

SEQ ID NO: 680 - protein, 530 aa, Avena sativa
MVLESLLGSAASVPWSFLLCGLLGMVLLWPTIRLLEQLWWQPRRLERALRAQGLRGTPYRFLIGDVNDYGRQNKESWSKPLPLRCHDIGAHVMPFLYNTVEEYGKPCISWFGPMPKVTITDPNLVKEVMSNKFGHIEKLKFPALSKLLAVGVANHEGEKWVKHRRILNPAFHVEKLKLMLPAFAACCEELVSRWTESLGPDGSWEVDVSSELQNLTGDVISQTAFGSSYLEGRRISQLQSEQMGRFMAAIHMIVIPGYMSFPTKNNRRMHQINNEIENILRSLISKRMQAIQEGESTKDDLLGLLLQSNMTSTDANGKTVLGMSRDEVMEECKLFYFAGMETTSVLLTWTMILLSMHPEWQDRAREEVLGLFGKHKLEYEGVSRLKIVTMILYEVLRLYPPATALTRKTYKEIEIGGITYPAGVVFELPVLFLHHDPDIWGNDVHQFRPDRFAEGISKASKETGAFFPFGWGPRICIGQNFALLEAKMALCMILQRFEFELASSYAHAPHTVMMMRPMHGAQIKLRAISS

SEQ ID NO: 681 - protein, 318 aa, Triticum aestivum
MGTLVGHVAPGAGFLLIGLWQLFNHIRLFVLRPGSYAAPLWFPARGVRHLELILIIAGTSASILMELVIGPAKHQPFDDDGTIPSDHLHNFEHASVSLALLAFAAVTIHMDRVRAPMRDAVSQLAAAAAFAQELLVFHLHSTDHMGVEGQFHWLLQTVVAVTLATTLLGIPYPRSFVVSLVRSASLVLQGVWLIVMGVMLWTPGLVPKGCFLNHEDGHDVVRCRTDEALHRAKALVNLQFSWYLTGTMVFVVVLYLQVSRLYPEEPQYLPLVKGGPSGGRFSVGDDDEDDDDEDDLEATKRGYGHVVSGGTKPMEVER

SEQ ID NO: 682 - protein, 318 aa, Aegilops tauschii
MGTLIGHVAPGAGFLLIGLWQLFNHIRLFVLRPSYYAAPLWFPARGVRHLELILIIVGTSASILMELVIGPAKHQPFDDDGTIPSDHLHNFEHASVSLALLAFAAVTIHMDRVRAPMRDAVSQLAAAAAFAQELLVFHLHSTDHMGVEGQFHWLLQTVIAVTLATTLLGIPYPRSFVVSLVRSASLVLQGVWLIVMGVMLWTPGLVSKGCFLNHEDGHDVVQCRTDEALHRAKALVNLQFSWYLTGTMVFVVVLYLQVSRLYPEEPQYLPLVKGRHAGGRVSIGDDREDDDDEEDLEATKRGYGHVVSGGTKPMEVER

SEQ ID NO: 683 - protein, 318 aa, Panicum virgatum
MGTLVGHVAPGAGFLLIGLWQLFSHIRLFLLRPSSYSAPVWFPARGVRHLELILIIVGTVISILMELVIGPEKHQPFDDDGTIPSNHLHNFEHASISLALLVFAAVTIHMDRVRAPMRDAVSQLVAAAAFAQQLLIFHLHSADHMGVEGQFHWLLQTVIAVTLATTLLGIPYPRSFTVSLVRSASLVLQGVWFIVMGIMLWTPALIPKGCFLNLEEGHDVVRCRTDEALDRAKSLVNLQFSWYLTGTVVFVVLFYLHMAKLYPEEPQYLPLVKGGGGGGDSDSRFSIGDDHDDEDDLEAAKRGFGHVVSGTKPVEIER

SEQ ID NO: 684 - protein, 318 aa, Panicum virgatum
MGTLVGHVAPGAGFLLIGLWQLFSHIRLFVLRPSSYSAPVWFPARGVRHLELILIIVGTVISILMELVIGPEKHQPFDDDGTIPSNHLHNFEHASISLALLVFAAVTIHLDRVRAPMRDAVSQLVAAAAFAQQLLIFHLHSADHMGVEGQFHWLLQTVIAVTLATTLLGIPYPRSFTVSLVRSASLVLQGVWFIVMGIMLWTPALIPKGCFLNLEEGHDVVRCRTDEALDRAKSLVNLQFSWYLTGTVVFVVLFYLHMAKLYPEEPQYLPLVKGGGGGGDSDSRFSIGDDHDDEDDLEAAKRGFGHVVSGTKPVEIER

SEQ ID NO: 685 - protein, 320 aa, Sorghum bicolor
MGTLVGHVAPGAGFLLIGLWQLFSHIRLFLLRPSSYSAPVWFPAPGVRHLELILIIIGAAMSILMELVIGPAKHQPFDDDGTIPSDHLHNFEHASISLALLVFAAVTIHLDRVKAPLRDAVSQLVAAAAFAQQLLIFHLHSADHMGVEGQFHWLLQTVIAVTLATTLLGIPYPRSIVVSLVRSASLVLQGVWFVVMGVMLWTPALIPKGCFLNLEEGHDVVRCRTDEALDRAKSLVNLQFSWYLTGTVVFVVLFYLQMAKLYPEEPQYLPLVKGGGGGGDDRDSRFSIGDDDHDDEDDVEAAKRGFGHVVSGTKPVEIER

SEQ ID NO: 686 - protein, 318 aa, Setaria italica
MGTLVGHVAPGAGFLLIGLWQLFSHTRLFLLRPSSYSAPVWFPVRGVRHLELILIIIGTVISILMELVIGPAKHQPFDDDGTIPSDHLHNFEHASISLALLTFAAVTIHLDRVKAPMRDAVSQLVAAAAFAQQLLIFHLHSADHMGVEGQFHWLLQTAIAVTLATTLLGIPYPRSFTVSLVRSASLVFQGVWFIVMGVMLWTPALIPKGCFLNREEGHDVVRCRTDEALDRAKSLVNLQFSWYLTGTVVFVVFFYLQLTKRYPEEPQYLPLVKGGGGGGDSDGRFSIGDDHDDEDDLEVAKRGFGHVVSGTKPIEIER

SEQ ID NO: 687 - protein, 316 aa, Panicum virgatum
MGTLVGHVAPGAGFLLIGLWQLFSHTRLFLLRPGSYTAPVWFPARGVRHLELILIIVGTVISILMELVIGPAKHQPFDDDGTIPSDHLHNFEHASISLALLVFAAVTIHLDRAWAPMRDAVSQLVAAAAFAQQLLIFHLHSADHMGVEGQFHWLLQTVIAVTLATTLLGIPCPRSFTVSLVRSASLVFQGVWFIVMGVMLWTPALIPKGCFLNLEEGHDVVRCRTDEALDRAKSLVNLQFSWYLTGTVVFVVLFYLHMAKLYPEEPQYLPLVKGGGGDSDSRFSIGDDHDDEDDLEASKRGFGHVVSGAKPVEIER

SEQ ID NO: 688 - protein, 323 aa, Brachypodium distachyon
MGTLVGHVAPGAGFLLIGLWQLFNHIRLFLLRPGSYVAPVWFPVRGVRHLELILVIAGSAMSILMELVIGPAKHQPFDDDGTIPSDHLHNFEHASISLALLLFAAVAIHMDRARPRAPPMRDAVSQLVAGAAFAQELLVFHLHSADHMGVEGQFHWLLQTVVAVTLLTTLLGIPCPRSIAVSLTRSASLVFQGVWFVVTGVMLWTPALVPKGCFLNREDGHDVVRCRDGEALERAKSLVNLQFSWYLTATVLFVVVFYLWLGKMYSEEPRYLPLVKGNHAEGDGDGGRFSIGDDQDDDEDDVESAKHSFGHVVSITKPIEIER

SEQ ID NO: 689 - protein, 491 aa, Saccharum officinarum
MGGGNGDGTTPLGEPLLAKQARAYRPRCPGCRVDRLNAEREGVFPLKDLFLIWLVTITCTLPIQSLFPFLYFMIRDLNIAKQTQDIGFYAGFVGASYMCGRAVSSTVWGIVADKHGRKPVIVLTLVAIVIFNTLFGLSSNYWMALITRCLLGVMCGYLGPIKAYATEVCRKEYNHLALAVVSSSRGIGLIIGPAIGGYLAQPADKYPSIFSQTSIFGRFPYFLPCLCISILAVVALIACIWFPETLHKHNEDTVDNSVETVEESLADTDTEENGGGGCLKLFTNWPLMSSITLYCIFSLQDVAYAETFSLWAVSDRSYGGLSFTTTDVGNVLAMSGLFLFLYQMLIYPLLAKMVDHITLVRAVAILTLPLLASYPFFPSLKGFMLMLVVNCASFLKNTFSVTTITVFNILMNEAVTQDVRAAANGIAVTLMSISKAVAPAVAGIIFSWAQRRQTASFLPGDHLVFFILNIFTLTGLIFTFRPFFVRGSAKH

SEQ ID NO: 690 - protein, 491 aa, Sorghum bicolor
MGGGNGDGTTPLGEPLLAKKGRAYRPRCPGCRVDRLNAEREGVFPLKDLFLIWLVTITCTLPIQSLFPFLYFMIRDLHIAKQTQDIGFYAGFVGASYMFGRALSSTIWGIVADKYGRKPVIVLTLVAIVIFNTLFGLSLNYWMALITRCLLGVMCGYLGPIKAYATEVVRKEYNHLALAVVSSSRGIGLIIGPAIGGYLAQPADKYPSIFSQTSIFGRFPYFLPCLCISILAVIALIACIWFPETLHKHNEDTVDNSVETVEESLAGTDTEENGGGGCLTLFKNWPLMSSITLYCIFSLQDVAYAETFSLWAVSDRSYGGLSFTTTDVGNVLAMSGLFLFLYQMLIYPLLAKAVDHITLVRAVAILTLPLLASYPFFPSLKGFVLMLVVNCASFLKNTFSVTTITVFNILMNEAVTQDVRAAANGIAVTLMSISKAVAPAVAGIIFSWAQRRQTASFLPGDHLVFFILNIFTLTGLIFTFRPFFVRGSAKH

SEQ ID NO: 691 - protein, 489 aa, Echinochloa colona
MSGGGGVTALGEPLLTKKGRAYRPRCPGCRVDRLNAEREGVFPFKDLFLIWLVTITCTLPIQSLFPFLYFMIRDLHIAKQTQDIGFYAGFVGASYMFGRAISSTVWGIVADKHGRKPVIVLTLVSIIIFNTLFGLSLNYWMALITRCLLGVMCGYLGPIKAYATEVCRKEYNHLALAVVSSSRGIGLIIGPAIGGYLAQPADKYPSIFSQTSIFGRFPYFLPCLCISILAAVALVACIWFPETLHKHNEDTVDKSVEAIEESLAGTDTEESGGGGCLQLFTNWPLMSAITLYCIFSLQDVAYAEVFSLWAVSDRSFGGLSFTSTDVGNVLAASGLFLFLYQMLVYPLLAKSVDHITLVRGVAILTVPLLASYPFFPSLSGFVLMLVVNFASFLKNTFSVTTITVFNILMNEAVPQDVRAAANGIAVTLMSISKAVAPAVAGIIFSWAQRRQTAAFLPGDHLVFFMLNVFTVTGLVFTFRPFFVRGSAKH

SEQ ID NO: 692 - protein, 493 aa, Echinochloa colona
MGDGGGGGGGVTALGEPLLTKKGRAYRPRCPGCRVDRLNAEREGVFPFKDLFLIWLVTITCTLPIQSLFPFLYFMIRDLHIAKQTQDIGFYAGFVGASYMFGRAISSTVWGIVADKHGRKPVIVLTLVSIIIFNTLFGLSLNYWMALITRCLLGVMCGYLGPIKAYATEVCRKEYNHLALAVVSSSRGIGLIIGPAIGGYLAQPADKYPSIFSQTSIFGRFPYFLPCLCISILAAVALVACIWFPETLHKHNEDTVDKSVEAIEESLSGTDTEESGGGGCLQLFTNWPLMSAITLYCIFSLQDVAYAEVFSLWAVSDRSFGGLSFTSTDVGNVLAASGLFLFLYQMLVYPLLAKSVDHITLVRGVAILTVPLLASYPFFPSLSGFVLMLVVNFASFLKNTFSVTTITVFNILMNEAVPQDVRAAANGIAVTLMSISKAVAPAVAGIIFSWAQRRQTAAFLPGDHLVFFMLNVFTVTGLVFTFRPFFVRGGAKH

SEQ ID NO: 693 - protein, 447 aa, Echinochloa colona
MGDGGGGGGGVTALGEPLLTKKGRAYRPRCPGCRVDRLNAEREGVFPFKDLFLIWLVTITCTLPIQSLFPFLYFMIRDLHIAKQTQDIGFYAGFVGASYMFGRAISSTVWGIVADKHGRKPVIVLTLVSIIIFNTLFGLSLNYWMALITRCLLGVMCGYLGPIKAYATEVCRKEYNHLALAVVSSSRGIGLIIGPAIGGYLAQPADKYPSIFSQTSIFGRFPYFLPCLCISILAAVALVACIWFPETLHKHNEDTVDKSVEAIEESLAGTDTEESGGGGCLQLFTNWPLMSAITLYCIFSLQDVAYAEVFSLWAVSDRSFGGLSFTSTDVGNVLAASGLFLFLYQMLVYPLLAKSVDHITLVRGVAILTVPLLASYPFFPSLSGFVLMLVVNFASFLKNTFSVTTITVFNILMNEAVPQDVRAAANGIAVTLMSISKAVAPAVAGII

SEQ ID NO: 694 - protein, 93 aa, Zea mays
MAAAAATKASSWMVAMSVGAVEALKDQGGLCRWNYALRSVYRTAKANVRSGSRSFAAQRDKDLAPAAEKGRQDKAAAEEGLRTVMYLSCWGPN

SEQ ID NO: 695 - protein, 545 aa, Sorghum bicolor
MGCFTVLRSKKKKIPFDNPLLPSKKSVDARESTSSRLPEPEVHVPSLQSAPPSFRNRTKISQSSNKVSNSRARVLSAPSTLIVVDQFGFPYAEYRDQDDSRDKEGSTKGHRFSNPLPLPLPSPEGHSFRNSGSFKASNVSGPLEMSGPLPLPPKKCDGLRIFSYEEVLSACQWFSSDQCVSEALGSTSYKATFRDEFIDTKTTEATVARLLPSTQSLKEFKTQATTLALLQHPNLCKLIGYYAKEDSNERMLVYERLHHGSLDKLLFGRPDGRFMDWSKRLKVALGAARGLAFLHDEGPFQAMYSEFSTLNIQIDKDFTAKLSGYGCVGFNTEEISNAPASAANLSVETLEKGLLTPKSNVWSFGVVLLELITGRKNLDANSSKEERNIVRWSRPFLTDDSRLSLIMDSRIKGRFPTKAARIVADIILQCLHNDPSERPTMRDVVEALARVQEIKVPCRYPLQEPSAAPRKVMLKSTSLNGIVPHHPVITFSPSPPSHNQHLISPRSSTSALFHPRTCSSTLDDPGVSSIKKTPPIMRRSSVEGF

SEQ ID NO: 696 - protein, 546 aa, Setaria italica
MGCFTALRSKKKKGPLDNPLVPSKKSIDARESTSSRLPEPEVHVPSLQSAPPSFRNRAKISQSANKVSNSRARVLSAPSTLIVVDQFGFPYAEYKDQDDSRDKEGSTKGHRFSNPLPLPLPSPEGHSLRNFGSFKASNVSGPLEISGPLPLPLEKYIGLRIFSYEEVSSACQWFSSDQCVSETLGSTSYKATFRDDFSGTKTTEATVARLLPSTQSLKEFKTQVNTLASLEHPNLCKLIGYYAKEDSNGRMLVYERLHHGSLDKLLFGRPDGRFMDWSKRLKVALGAARGLAFLHDEGPFQAMYSEFSTSNIQIDKDFTAKLSGYGCAGFNTEEISNAPVSAAHLSVETLAKGLLTPKSNVWSFGVVLLELITGRKNLDVSSSKEERNIVKWSRPFLTDDSRLSLIMDSRIKGRFPTKAARIVADIILKCLHNDPSERPTMRDVVEALTGVQEIKVPCRYPLQEPSAAPRKRMLKSTSLNGIVPQHPVITFSPSPPSHNQPLISPRSSTSALLHPRTCYSTLDDPRVSSIRKTPPPIMRRSSVEGF

SEQ ID NO: 697 - protein, 547 aa, Panicum virgatum
MGCFTVLRSKKKKCPLDNPFVPSKKSIDARESTSSRLPEPEVHVPSLQSAPPSFRDRAKISQSANKVYNSRARVLSAPSTLIVVDQFGFPYTEYRDQDDSRDKEGSTKGHRFSNPLPLPLPSPEGHSLRNFGSFKANNVSGPLEMSGPLPLPPKKCDGLRIFSYDEVSSACQWFSSDQCVSETLGSTSYKATFRDDFSDTKTTEATVARLLPSTQSLKEFKAQVNTLASLQHPNLCKLIGYYAREDSNGRMLVYERLHHGSLDKLLFGRPDGRFMDWSKRLKVALGAARGLAFLHDEGPFQAMYSEFSTSNIQIDKDFTAKLSGYGCVGFSTEEEISNAPASAANLSVETLEKGLLTPKSNVWSFGVVLLELITGRKNLDASSAKEERNIVKWSRPFLTDDSRLSLIMDSRIKGRFPTKAARIVADIILKCLHKDPSERPTMRDVVEALAGVQEIKVPCRYPLQEPSAAPRKIMLKSTSLNGIVPQHPIITFSPSPPSHNQHLISPRSSTSALLHPRMCSPTLDDPRVRSTKKTPPPIMRRSSVEGF

SEQ ID NO: 698 - protein, 547 aa, Panicum virgatum
MGCFTVLRSKKKKCPLDNPFVPSKKSIDARESTSSRLPEPEAHVPSLQSAPPSFRDRAKISQSANKVYNSRARVLSAPSTLIVVDQFGFPYAEYRDQDDSRDKEGSTKGHRFSNPLPLPLPSPEGHSLRNFGSFKASNVSGPLEMSGPLPLPPKKCDGLRIFSYEEVSSACQWFSSDQCVSETLGSTSYKATFRDDFSDTKTTEATVARLLPSTQSLKEFKAQVNTLASLQHPNLCKLIGYYAREHSNGRMLVYERLHHGSLDKLLFGRPDGRFMDWSKRLKVALGAARGLAFLHDEGPFQAMYSEFSTLNIQIDKDFTAKLSGYGCVGFSTEEEISNVPACAANLSVETLEKGLLTPKSNVWSFGVVLLELITGRKNLDASSSKEEHNLVKWSRPFLTDDSRLSLIMDSRIKGRFPTKAARIVADIILKCLNKDPSGRPTMRDVVEVLAGVQEIKVPCRYPLQEPSAAPRKIMLKSTSLNGIVPQHPTITFSPSPPSHNQHLISPRSSTSALLHPRMCSPTLDDPRVSSMKKTPPPIMRRSSVEGF

SEQ ID NO: 699 - protein, 542 aa, Oryza sativa
MMGCFTVLRSKKKKPLALTKKSVDARESTSSRLPEPEAHVPSLQSAPPSFRNKAKIHQSEKKASYSRARVLSAPSSLIVVDQDGLPYAEFDDQDDSRGKGGSIKGHRFSNPLPLPLPSPEGKSLRNFGSFKAINASGPLDASGPLPLPPKKCDGLKNFSYEELSSACQWFSGDQCVSESLTSTSYKASFRDDFTDPKTIEAIVSRLLSSTQSLKEFKTQVNTLASLQHPNLCKLIGFHAREESNERMLVYERLHHGSLDKLLFGRSDGRFMDWSARLKVALGAARGLAFLHDEGPFQAMYNDFSTSNIQIDKDFTAKLSGYGCVGFNTEEEISNASVAAANLSVETLEKGVLTPKSNVWCFGVVLLELITGRKNLDVRSSKEERNIVKWSRPFLTDDSRLSLIMDSRIKGRFPTKAARIVADIILRCLNKDPSERPTMRAVVESLASVQDIKVPCRYPLQEPSAAPRKVMLKSTSLNGIIHHHPVVTFSPSPPSRNQHLLSPRSSTSALLPPRTSCALDDPRVSSIKKSPSPILRRSGVEGF

SEQ ID NO: 700 - protein, 404 aa, Setaria italica
MEAVEDIVIAGAGLAGLATALGLHRKGVRSLVLESSPMLRASGFAFTTWTNAFRALDSLGVGDKIREHHLLYERMITFSAATGEPAAKVSLKMQAKSGPHEIRCVKRDFLLQTLENELPKGTIRYSSKIVAIEEDGNATVLHLADGSIIKTKVLIGCDGVNSVVAKWLGLPKPILSGRSATRGLAEYPAGHCFGPEILQFIGQGFRSGVLPCSDTSVYWNYTWYPSPADGDAEESVAKMRSHVLGKLRAAKIPAAALDAIERSEMSDVVSSPLRFRSPLALLRGSISRGGVCVAGDALHPMTPELGQGGCAALEDGVVLARCLGEAFAAAGSGGGGHDGVIRAALEKYAEARRWRSIQLITAAYVVGFIQQSNNVVVKFLRDTFLSPLLAKTLVAMADYDCGTL

SEQ ID NO: 701 - protein, 399 aa, Panicum virgatum
MAAVEDIVIAGAGLAGLATALGLHRKGVRSLVLESSPTLRASGFAFTTWTNAFRALDALGVGDKIREHHLLYERMVTFSAATGEAAAKVSLKMQGKSGPHEIRCVKRDFLLQTLENELPKGTIRYSSKIVSIEEDGNVTVLHLADGSTMKTKVLIGCDGVNSVVAKWLGLPKPILSGRSATRGLAEYPAGHGLGPEILQFIGQGFRSGVLPCSDTSVYWNYTWYPSPADGDAEESVAKMRSFVLAKLRAAKIPATVLGVIERSEMSEVVSSPLRFRSPLALVRGSISRGGICVAGDALHPMTPELGQGGCAALEDGVVLARCLGDAFAAGDGGHKAVAAALGRYAEARRWRSVQLITAAYVVGFIQQSNNVVVKFLRDTFLSPLLAKTLVAMADYDCGT

SEQ ID NO: 702 - protein, 406 aa, Oryza sativa
MEGSGVEGIVIAGAGLAGLATALGLHRKGVRSLVLESSATLRASGFAFTTWTNAFRALDALGVGDKIREHHLLYERLLAFSASTGEPAAKLSLKMQGKSGPHEIRCVKRNFLLETLENELPEGTIRFSSKIVSIEEDGNVKLLHLSDGSTIRAKVLIGCDGVNSVVAKWLGLPKPILSGRSATRGLAEYPAGHGFGPEILQFIGQGFRSGVLPCSDTSVYWNYTWYPSPDDGDAEESVAKMRSYVVAKLRAARIPAEALDVIERSEMSDVVSSPLRFRSPLALVRGSISRGNVCVAGDAFHPTTPELGQGGCAALEDGVVLARCLSEAFLADGAEHDPGYEAVKAALEKYAEERRWRGIRLITAAYVVGFIQQSTNPVIKFLREKFLSGLLAKTMIAMADYDCGKL

SEQ ID NO: 703 - protein, 387 aa, Pennisetum glaucum
MEAVEDVVIAGAGLAGLATALGLHRKGVRSLVLESSPMLRASGFAFTTWTNAFRALDALGVGDKIREHHLLYERMITFSAATGEPAAKVSLKIQGKRGPHENRCVKRDFLLQTLENELPKGTIRYSSKIVAIEEDGNVTVLHLADGSIIRTKVLIGCDGVNSVVAKWLGLPKPILSGRSATRGLAEYPAGHGFGPEILQFIGQGFRSGVLPCSDTSVYWNYTWYPSPADGDAEESVAKMRSHVLGKLRAAKIPAAALDVIERSEMSDVVSSPLRFRSPLALLRGSISRGGVCVAGDALHPMTPELGQGGCAALEDGVVLARCLGEAFPATSSAGHDGAIRAALEKYAEERRWRSIQLITAAYVVGFIQQSNNIVVKFMRDTFLSPLL

SEQ ID NO: 704 - protein, 415 aa, Sorghum bicolor
MAAASSRWTPAAGLLLLLLLLVPFAAIPSRAATPAASSTAIFQLQGNVYPTGHYYVTMNIGNPAKPYFLDVDTGSDLTWLQCDAPCRSCNKVPHPLYRPTANSLVPCANALCTALHSGHGSNNKCPSPKQCDYQIKYTDSASSQGVLINDNFSLPMRSSNIRPGLTFGCGYDQQVGKNGAVQAATDGMLGLGRGSVSLVSQLKQQGITKNVLGHCLSTNGGGFLFFGDDIVPTSRVTWVPMAKISGNYYSPGSGTLYFDRRSLGVKPMEVVFDSGSTYTYFTAQPYQAVVSALKSGLSKSLKQVSDPSLPLCWKGPKAFKSVFDVKKEFKSLFLSFASAKNAVMEIPPENYLIVTKNGNVCLGILDGAAAKLNFNVIGDITMQDQMVIYDNEKSQLGWARGACTRSAKSIMSSFP

SEQ ID NO: 705 - protein, 408 aa, Panicum virgatum
MAAALLLAVLLPLVATPSRAAAPAARAASTAAFQLHGDVYPTGHYYVTMNLGNPAKPYFLDVDTGSDLTWLQCDAPCRSCNKVPHPLYRPAQNRLIPCADSLCTALHSGLGTNNKCPSPKQCDYRIKYTDSASSQGVLINDNFSLPLSKSSNIRPSLTFGCGYDQQVGKNGAVQAVTDGLLGLGRGSVSLLSQLKQQGVTKNVLGHCLSTKGGGFLFFGDDIVPTSRVTWVPMARSTSGNYYSAGSGSLQFDGRSLGVKPMEVVFDSGSTYTYFTAQPYQAVVSALKGGLSKSLKQVSDPELPLCWKGQKAFKSVFDVKKEFKPLSLSFPNAKNAVMDIPPENYLVVTKNGNACLGILDGTAAKLSFNVIGDITMQDQMVIYDNEKAQIGWVRGPCSRSAKSILSSFP

SEQ ID NO: 706 - protein, 416 aa, Echinochloa colona
MAAAARRAPVAVLLLAALLLLLLAATSRAATPPRPASTAVFQLHGDVYPTGHYYITVNIGNPAKPYFLDVDTGSDLTWVQCDAPCQSCNKVPNQWYRPTPNRLVPCADSLCTALHNELGANNKCPSPKQCDYRIKYADNASSQGVLIADNFTLTMIKSSTVRPSLTFGCGYDQQVGKNGAVQAPTDGLLGLGRGSVSLLSQLKQQGITKNVLGHCLSTNGGGFLFFGDDIVPTSRVTWVPMARTTSGNYYSPGSGTLYFDRRSLGVKPMEVVFDSGSTYTYFTAQPYQAVVLALKAGLSKSLKQVSDPELPLCWKGQKAFKSVFDVKKEFKSLFLSFGTGKNAVMEIPPENYLVVTKNGNACLGILDGTTAKLSFNVIGDITMLDQMVIYDNEKAQLGWVRAACSRSAKSIMSSFP

SEQ ID NO: 707 - protein, 419 aa, Setaria italica
MAAAAMRAPTAVLLLAVLLPFAAAPSRAATLATSPSASTSTAAFQLHGDVYPTGHYYITMNIGDPAKPYFLDVDTGSDLTWLQCDAPCQSCNKVPHPLYRPAPKKLVPCADSLCTALHSGLGSGNRCPSPKQCDYRIKYTDSATSQGVLIADNFSLPLSKSSTVRPSLTFGCGYDQQVGKNGEKPAVTDGLLGLGRGSVSLLSQLKQQGITKNVLGHCLSTNGGGFLFFGDGIVPTSRVTWVPMARSTSGNYYSPGSGTLYFDKRSLGLKPMEVVFDSGSTYTYFTAQPYQAVVSALKGGLSKSLKQVPGDELPLCWKGQKAFKSVFDVKKEFKSLHLSFATGKNAVMEIPPENYLIVTKIGNVCLGILDATVAKLSFSVIGDITMLDQMVIYDNEKAQLGWVRGPCSRSAKSILSSIP

SEQ ID NO: 708 - protein, 1456 aa, Setaria italica
MDAAGDIQKVASMRRGDSGSMWRRGDDVFSRSSREEDDEEALRWAALEKLPTYDRVRRAIVPLGLGGDGAEAAGGGKGVVDVDVLSLGPQQRRALLERLVRVADEDNERFLLKLKDRVDRVGIDMPTIEVRFQNLEAEAEVRVGSSGLPTVLNSIVNTVEEAANALHLLPSRKRTMPILHDVSGIIKPRRMTLLLGPPGSGKTTLLLALAGRLDKDLKVTGKVTYNGHEMTEFVPERTAAYISQHDLHIGEMTVRETLAFSARCQGVGSRFDMLTELSRREKAANIKPDADIDAFMKASAMGGQEANVVTDYILKILGLEICADTMVGDEMLRGISGGQRKRVTTGEMLVGPARALFMDEISTGLDSSTTFQIVNSLRQSIHILGGTAVISLLQPAPETYNLFDDIILLSDGQVVYQGPREEVLEFFESLGFRCPERKGVADFLQEVTSKKDQKQYWARRDEPYRFVPVKEFATAFKSFHAGRAIANELAVPFDKSKSHPAALTTTRYGVSGKELLKANIDREILLMKRNSFVYMFRTFQLMLMSIIAMTLFFRTKMKHDTVTDGGLYMGALFFGVLMIMFNGFSELALTVFKLPVFFKQRDLLFFPAWSYTIPSWILKIPITFIEVGGYVFLTYYVIGFDPNVGRFFKQYLLLLAVNQMAAALFRFIGGAARNMIVANVFASFMLLVVMVLGGFILVREKIKKWWIWGYWISPMMYAQNAISVNEMLGHSWDKILNATASNETLGVQVLKSRGVFTEAKWYWIGFGAMVGFTILFNALFTLALTYLKPYGNSRPSVSEEELNEKHANMKGEVLDGNHLVSARSHRSTRANTETDSAIGEDDSSPAKRGMILPFVPLSLTFDNIRYSVDMPQEMKAQGVQEDRLELLKGVSGSFRPGVLTALMGVSGAGKTTLMDVLAGRKTGGYIEGDISISGYPKKQETFARISGYCEQNDIHSPQVTVYESLLFSAWLRLPKDVDSNTRKIFIEEVMELVELKPLRDSLVGLPGVNGLSTEQRKRLTIAVELVANPSIIFMDEPTSGLDARAAAIVMRTVRNTVDTGRTVVCTIHQPSIDIFEAFDELFLMKRGGEEIYAGPLGHHSSELIKYFEGIQGVSKIKDGYNPATWMLEVTTVSQEQILGVDFSEIYKNSELYQRNKALIKELSQPAPGSSDLHFPSKYAQSSITQCMACLWKQNLSYWRNPPYNTVRFFFTTIIALLLGTIFWDLGGKVKTSQDLLNAMGSMYSAVLFIGVMNCTSVQPVVAVERTVFYRERAAGMYSAFPYAFGQVVIELPYALAQDILYGVIVYSMIGFEWTAAKFFWYLFFGYFTLLYFTFYGMMAVGLTPNYHIASIVSSAFYAIWNLFSGFIIPRPRVPIWWRWYCWICPVAWTLYGLVVSQFGDMMTEMDNGKTVKVFIEDYFDFKHSWLGWVAAVVVAFAVLFAALFGFAIMKLNFQKR

SEQ ID NO: 709 - protein, 1444 aa, Zea mays
MDAAGDIQKVASMRRGDSGSMWRRGDDVFSRSSREEDDEEALRWAALEKLPTYDRIRRAIVPLGLGDEAPGSKGLVDVDVLSLGPRERRALLERLVRVADEDNERFLLKLKDRIDRVGIDMPTIEVRFQNLEAEAEVRVGSSGLPTVLNSVVNTVEEAANALHILPSRKQIMPILHDVSGIIKPRRLTLLLGPPGSGKTTLLLALAGRLDKDLKFSGKVTYNGHEMTEFVPERTAAYISQHDLHIGEMTVRETLAFSARCQGVGSRLDMLTELSRREKAANIKPDADIDAFMKASALGGQDANVVTDYILKILGLDICADTMVGDEMLRGISGGQRKRVTTGEMLVGPARALFMDEISTGLDSSTTFQIVNSLRQSIHILGGTAVISLLQPAPETYNLFDDIILLSDGQVVYQGPREEVVEFFESVGFRCPERKGVADFLQEVTSKKDQKQYWARPDEPYRFVSVKELATAFKSSHTGRALANELAVPFDKSKSHPAALTTTRYGVSGKELLKANIDREILLMKRNSFVYMFRTFQLMVMSIIAMTLFFRTKMKHDTVNDGGIYMGALFFGVLMIMFNGLSELALTVFKLPVFFKQRDLLFFPAWSYTIPAWILKVPITFIEVGGYVFLTYYVIGFDPNVGRFFKQYLLLLAVNQMTAALFRFVGGVSRNMIVANVFASFMLLVVMVLGGFILQRDKVKKWWIWGYWISPMMYAQNAISVNEMLGHSWDKILNSTASNETLGVQVLKSRGVFPEAKWYWIGFGAMVGFTILFNALFTLALTYLKPYGNSRPSVSKEELKEKHANIKGEVVDGNHLVSVNPETDSAIMEDDSASTKKGMILPFVPLSVTFDNIKYSVDMPQEMKGQGVQEDRLELLKSISGSFRPGVLTALMGVSGAGKTTLMDVLAGRKTGGYIEGDIRISGYPKKQETFARVSGYCEQNDIHSPQVTVYESLLFSAWLRLPKDVDSNKRKIFIEEVMELVELKPLRNALVGLPGVNGLSTEQRKRLTIAVELVANPSIIFMDEPTSGLDARAAAIVMRTVRNTVDTGRTVVCTIHQPSIDIFEAFDELFLMKRGGEEIYAGPLGHNSSELIKYFEEIQGVSKIKDGYNPATWMLEVTTISQEQILGVDFSDIYKKSELYQRNKALIKELSQPAPGSTDLHFSSKYAQSFNTQCVACLWKQNLSYWRNPPYNTVRFFFTGIIALLLGTIFWDLGSKVYTSQDLLNAMGSMYSAVLFIGVMNCTSVQPVVAVERTVFYRERAAGMYSAFPYAFGQVVIELPYALAQDILYAVIVYSMIGFEWTVAKFFWYLFFGYFTLLYFTFYGMMTVGLTPNYHIAAIVSAAFYAIWNLFSGFVIPRPKVPIWWRWYCWICPVAWTLYGLVVSQYGDIMTEMDDKRTVKVFVEDYFDFKHSWLGWVAAVVVAFGVLFATLFAFAIMKLNFQKR

SEQ ID NO: 710 - protein, 1452 aa, Panicum virgatum
MDAAGDIQKVVSMRRGNSGSMWRRGDDVFSRSSREEDDEEALRWAALEKLPTYDRVRRAIVPLGDGAEAGGGKGLVDVDVLSLGPQQRRALLERLVRVADEDNERFLLKLKDRVDRVGIDMPTIEVRFQNLEAAAEVRVGSSGLPTVLNSIVNTVEEAANALHLLPSRKRTMPILHDVSGIIKPRRMTLLLGPPGSGKTTLLLALAGRLDKDLKVSGKVTYNGHEMTEFVPERTAAYISQHDLHIGEMTVRETLAFSARCQGVGSRFDMLTELSRREKAANIKPDADIDAFMKASAMGGKEASVITDYILKILGLEICADTMVGDEMLRGISGGQRKRVTTGEMLVGPAKALFMDEISTGLDSSTTFQIVNSLRQSIHILGGTAVISLLQPAPETYNLFDDIILLSDGQVVYQGPREEVIEFFESMGFRCPERKGVADFLQEVTSKKDQKQYWARRDEPYRFVTVKEFAMAFKSFHTGRAIENELAVPFDKSKSHPAALTTTRYGVSGKELLKANIDREILLMKRNSFVYMFRTFQLMLMSIIAMTLFFRTKMKHDTVNDGGLYMGALFFGVLMIMFNGFSELALTVFKLPVFFKQRDLLFFPAWSYTIPSWILKIPITFIEVGGYVFLTYYVIGFDPNVGRLFKQYLLLLAVNQMAAALFRFIGGVARNMIVANVFASFMLLVVMVLGGFILVREKIKKWWIWGYWISPMMYAQNAISVNEMLGHSWDKILNSTASNDTLGVQTLKSRGVFPEAKWYWIGFGAMIGFTILFNALFTLALTYLKPYGNSRTSVSEEELKEKHANIKGEVLDGNHLASASSHRPKGINNEADPAIVEDDSALTKRGMILPFVPLSLTFDDIRYSVDMPQEMKAQGVQEDRLELLKGVSGSFRPGVLTALMGVSGAGKTTLMDVLAGRKTGGYIEGDISISGYLKKQETFARVSGYCEQNDIHSPQVTVYESLLFSAWLRLPKDVDSNKRKIFIEEVMELVELKPLRDALVGLPGVNGLSTEQRKRLTIAVELVANPSIIFMDEPTSGLDARAAAIVMRTVRNTVDTGRTVVCTIHQPSIDIFEAFDELFLMKRGGEEIYAGPLGHHSSELIKYFEGIQGVSKIKDGYNPATWMLEVTTVSQEHILGVDFSEIYKKSELFQRNKALIKELSQPAPGSSDLHFPSKYAQSSITQCMACLWKQNLSYWRNPPYNTVRFFFTTVIALLLGSIFWDLGGKVKTSQDLLNAMGSMYSAVLFIGVMNCTSVQPVVAVERTVFYRERAAGMYSAFPYAFGQVVIELPYALAQDILYGVIVYSMIGFEWTAAKFFWYLFFGYFTLLYFTFYGMMAVGLTPNYHIASIVSSAFYAIWNLFSGFIIPRPKVPIWWRWYCWICPVAWTLYGLVVSQFGDMMSRMDDGRTVKVFVEDYFDFKHSWLGWVAAVVVGFAVLFAALFGFAIMKLNFQKR

SEQ ID NO: 711 - protein, 1458 aa, Sorghum bicolor
MDAAGDIQKVASMRRGGSVSMWRRGDDVFSRSSREEDDEEALRWAALEKLPTYDRVRRAIVPLDLGADGAEAPGRKGLVDVDVLSLGPRDRRALLERLVHVADEDNERFLLKLKDRVDRVGIDMPTIEVRFQNLGAEAEVRVGSSGLPTVLNSVVNTVEEAANALHILPSRKQIMPILHDVSGIIKPRRLTLLLGPPGSGKTTFLLALAGRLGKDLKFSGKVTYNGHEMTEFVPERTAAYISQHDLHIGEMTVRETLAFSARCQGVGSRFEMLTELSRREKAASIKPDADIDAFMKASAMGGQDANVVTDYILKILGLEICADTMVGDEMLRGISGGQRKRVTTGEMLVGPSRALFMDEISTGLDSSTTFQIVNSLRQSIHILGGTAVISLLQPAPETYNLFDDIILLSDGQVVYQGPREEVLEFFESVGFRCPERKGVADFLQEVTSKKDQKQYWARLDAPYRFVSVKEFATAFKSFHTGRAIANELAVPFDKSKSHPAALTTTRYGVSGKELLKANIDREILLMKRNSFVYIFRTFQLVLMSIIVMTLFFRTKMKHDTITDGGIYLGAVFFGVLLTMFNGFSELALTVFKLPVFFKQRDLLFFPAWSYTIPSWILKIPITFIEVGGYVFLTYYVIGFDPNVSRFFKQYLILLAVNQMAAALFRFIGGASRNMIVSNVFASFMLLVVMVLGGFILQKDKIKKWWIWGYWISPMMYAQNAISVNEMLGHSWDKILNSTASNETLGVQSLKSRGVFTEAKWYWIGFGAMVGFTILFNALFTLALTYLKPYGNSWPSVSEEELQEKHANIKGEVLDGNHLVSASTHQSTGVNTETDSAIMEDDSVSTKKGMILPFDPLSLTFDNIKYSVDMPQEMKAQGVQEDRLELLKGVSGSFRPGVLTALMGVSGAGKTTLMDVLAGRKTGGYIEGDIRISGYPKKQETFARVSGYCEQNDIHSPQVTVYESLLFSAWLRLPKDVDSNKRKIFIEEVMELVELTPLRNALVGLPGVNGLSTEQRKRLTIAVELVANPSIIFMDEPTSGLDARAAAIVMRTVRNTVDTGRTVVCTIHQPSIDIFEAFDELFLMKRGGEEIYAGPLGHHSSDLIKYFEGIQGVSKIKDGYNPATWMLEVTATSQEQILGVDFSDIYKKSELYQRNKVLIKELSQPVPGSSDLHFASTYAQSSITQCVACLWKQNLSYWRNPPYNTVRFFFTTIIALLLGTIFWDLGGKVSTSQDLMNALGSMYSAVLFIGIMNCTSVQPVVAVERTVFYRERAAGMYSAFPYAFGQVVIELPYALVQDILYGVIVYSMIGFEWTAAKFFWYLFFGYFTLLYFTFYGMMAVGLTPNYHIASIVSSAFYAIWNLFSGFIIPRPKTPIWWRWYCWICPVAWTLYGLVVSQFGDIMTPMDDNNRTVVVSQYVEDYFGFKHSWLGWVAAVVVAFAVLFATLFGFAIMKLNFQKR

SEQ ID NO: 712 - protein, 1454 aa, Panicum virgatum
MDAAGDIVKVASMRRGNSGSMWRRGEDVFSRSSREEDDEEALRWAALEKLPTYDRVRRAMVPLGDGAEAGAGGGKGLVDVDVLSLGPQQRRALLERLVRVADEDNERFLLKLKDRVDRVGIDMPTIEVRFQNLEAEAEVRVGSSGLPTVLNSIVNTVEEAANALHLLPSRKRTMPILHDVSGIIKPRRMTLLLGPPGSGKTTLLLALAGRLDKDLKVSGKVTYNGQEMTEFVPERTAAYISQHDLHIGEMTVRETLAFSARCQGVGSRFDMLTELSRREKAANIKPDADIDAYMKASAMGGQEASVVTDYILKILGLEICADTMVGDEMLRGISGGQRKRVTTGEMLVGPARALFMDEISTGLDSSTTFQIVNSLRQSIHILGGTAVISLLQPAPETYNLFDDIILLSDGQVVYQGPREEVIEFFESMGFRCPERKGVADFLQEVTSKKDQKQYWARRDEPYRFVTVKEFAMAFKSFHTGRAIENELSVPFDKSKSHPAALTTTRYGVSGKELLKANIDREILLMKRNSFVYMFRTFQLMLMSIIAMTLFFRTKMKHDTVIDGGLYMGALFFGVLLIMFNGFSEMAMTVFKLPVFFKQRDLLFFPAWSYTIPSWILKIPITFIEVAGYVFLTYYVIGFDPNVGRFFKQYLLLLAINQMAAALFRFIGGVARNMIVANVFASFMLLVVMVLGGFILVREKIKKWWIWGYWISPMMYAQNAISVNEMLGHSWDKILNSTASNETLGVQILKSRGIFPEAKWYWIGFGAMIGFTILFNALFTLALTYLKPYGNSRPSVSEEELKEKHANMKGEVLDGNHLASASSHRSTGMNIETDPAIVEDDSALTKRGMILPFVPLSLTFDNIRYSVDMPQEMKAQGVQEDRLELLKGVSGSFRPGVLTALMGVSGAGKTTLMDVLAGRKTGGYIEGDISISGYPKKQETFARVSGYCEQNDIHSPQVTVYESLLFSAWLRLPKDVDSKKRKIFIEEVMELVELKPLRDALVGLPGVNGLSTEQRKRLTIAVELVANPSIIFMDEPTSGLDARAAAIVMRTVRNTVDTGRTVVCTIHQPSIDIFEAFDELFLMKRGGEEIYAGPLGHHSSELIKYFEGIQGVSKIKDGYNPATWMLEVTTASQEQILGVDFSEMYKKSELFQRNKALIKELSQPAPGSSDLHFPSKYAQSSITQCMACLWKQNLSYWRNPPYNTVRFFFTTIIALLLGSIFWDLGGKVKTSQDLLNAMGSMYSAVLFIGVMNCTSVQPVVAVERTVFYRERAAGMYSAFPYAFGQVVIELPYALAQDILYGVIVYSMIGFEWTVAKFFWYLFFGYFTLLYFTFYGMMAVGMTPNYHIASIVSSAFYAIWNLFSGFIIPRPKVPIWWRWYCWICPVAWTLYGLVVSQFGDVLTRMDDDRTVKMFVEDYFDFKHSWLGWVAAVVVGFAVLFGALFGFAIMKLNFQKR

SEQ ID NO: 713 - protein, 1453 aa, Sorghum bicolor
MDVTGELQKVASMRGGSGSMWRRGDDVFSRSSREEDDEEALRWAALEKLPTYDRVRRAIVPLDLGADGAEAAGGKGLVDVDVLSLGPRERRALLERLVRVADEDNERFLLKLKDRVDRVGIDMPTIEVRFQNLEAEAEVRVGSSGLPTVLNSIVNTVEEAANALHILPSSKRIMPILHDVSGIIKPRRLTLLLGPPGSGKTTLLLALAGRLDKDLKFSGKVTYNGHEMTEFVPERTAAYISQHDLHIGEMTVRETLAFSARCQGVGSRFDMLTELSRREKAANIKPDADIDAFMKASAMGGQDANVVTDYILKILGLEICADTMVGDEMLRGISGGQRKRVTTGEMLVGPSRALFMDEISTGLDSSTTFQIVNSLRQSIHILGGTAVISLLQPAPETYNLFDDIILLSDGQVVYQGPREEVLEFFESVGFRCPERKGVADFLQEVTSKKDQKQYWARLDAPYRFVSVKEFATAFKSFHTGRAIANELAVPFDKSKGHPAALTTTRYGVSGKELLKANIDREILLMKRNSFVYIFRTFQLVLMSIIVMTLFFRTKMKHDSVTDGGIYLGAVFFGVLMIMFNGFSELALTVFKLPVFFKQRDLLFFPAWSYTIPSWILKIPISFIEVGGYVFLTYYVIGFDPNVGRFFKQYLLLLAVNQMAAALFRFIGGASRNMIVANVFASFMLLVVMVMGGFILVRDKIKKWWIWGYWISPMMYAQNAISVNEMLGHSWDKILNSAASNETLGLQSLKSRGVFTEPKWYWIGFGALVGFTLLFNALFTLALTYLKPYGNSRPSVSEEELQEKHANIKGGNHLVSASSHQSTGLNTETDSAIMEDDSASTKKGMILPFDPLSLTFDNIKYSVDMPQEMKAQGVQEDRLELLKGVSGSFRPGVLTALMGVSGAGKTTLMDVLAGRKTGGYIEGDICISGYPKKQETFARVSGYCEQNDIHSPQVTVYESLLFSAWLRLPKDVDSNTRKIFIEEVMELVELKPLRNALVGLPGVNGLSTEQRKRLTIAVELVANPSIIFMDEPTSGLDARAAAIVMRTVRNTVDTGRTVVCTIHQPSIDIFEAFDELFLMKRGGEEIYAGPLGHHSSDLIKYFEGIQGVSKIKDGYNPATWMLEVTTTSQEQILGVDFSDIYKKSELYQRNKALIKELSHPVPGSSDLHFASTYAQSSITQCVACLWKQNLSYWRNPPYNTVRFFFTTIIALLLGTIFWDLGGKVSTSQDLMNALGSMYAAVIFIGVMNCTSVQPVVAVERTVFYRERAAGMYSAFPYAFGQVVIELPYALVQDILYGVIVYAMIGFEWTAAKFFWYLFFGYFTLLYFTFYGMMAVGLTPNYHIASIVSSAFYAIWNLFSGFIIPRPKTPIWWRWYCWICPVAWTLYGLVVSQFGDIMTEMDDNNRTVVVSQYVEDYFGFKHSWLGWVAAVVVAFAVLFAALFGFAIMKFNFQKR

SEQ ID NO: 714 - protein, 1407 aa, Sorghum bicolor
MDAAGDIQKVASMRRGGSGSVWRRGDDVFSRSSREEDDEEALRWAALEKLPTYDRVRRAIVPLDGDEAAGGKGLVDVDVLSLGPRERRALLERLVRVADEDNERFLLKLKDRIDRVGIDMPTIEVRFQNLEAEAEVRVGSSGLPTVLNSVVNTVEEAANALHILPSRKRIMPILHDVSGIIKPRRLTLLLGPPGSGKTSLLLALAGRLDKDLKFSGKVTYNGHEMTEFVPERTAAYISQHDLHIGEMTAYAMGGQDANVVTDYILKILGLEICADTMVGDEMLRGISGGQRKRVTTGEMLVGPARALFMDEISTGLDSSTTFQIVNSLRQSIHILGGTAVISLLQPAPETYNLFDDIILLSDGQVVYQGPREEVPEFFESVGFRCPERKGVADFLQEVTSKKDQKQYWVRPDEPYRFVSVKEFATAFKSFHTGRAIANELAVPFDKSKSHPAALTTTRYGVSGKELLKANIDREILLMKRNSFVYTFRTFQLILNSIITMTLFFRTKMKHDTVNDGGLYMGAVFFGVVLIMFNGMSELSLTVFKLPVFFKQRDLLFFPAWSYTLPSWIVKVPITFIEVGGYVFLTYYVIGFDPNVSRFFKQYLLLLAVNQMAAALFRFISGASRNMIVANVSASFMLLVVMVLGGFILQKDKIRKWWIWGYWISPMMYAQNAISVNEMLGHSWDKILNSTASNETLGVQSLKSRAVFTEAKWYWIGFGAMVGFTILFNALFTLALTYLKPYGNSRPSVSEEQLQEKHANIKGEVLDANHLVSAFSHRSTDVNTETDLAIMEDDSASSKKGMILPFDPLSLTFDNIKYSVDMPQEMKAQGVQEDRLELLKGVSGSFRPGVLTALMGVSGAGKTTLMDVLAGRKTGGYIEGDIRISGYPKKQETFARVSGYCEQNDIHSPQVTVYESLLFSAWLRLPKDVDSNKRKIFIEEVMELVELKPLRNALVGLPGVNGLSTEQRKRLTIAVELVANPSIIFMDEPTSGLDARAAAIVMRTVRNTVDTGRTVVCTIHQPSIDIFEAFDELFLMKRGGEEIYAGPLGHHSSELINYFEAIQGVSKIKDGYNPATWMLEVTTTSQEQILGLDFSDMYKKSELYQRNKALIKELSQPAPGSSDLHFPSKYAQSSITQCVACLWKQNMSYWRNPPYNTVRFFFTTIIALLLGTIFWDLGGKVSTQQDLMNAMGSMYSAVLFIGIMNCTSVQPVVAVERTVFYRERAAGMYSAFPYAFGQVVIELPYALVQDILYGVIVYSMIGFEWTAAKFFWYLFFGYFTLLYFTFYGMMTVGLTPNYHIASIVSSAFYALWNLFSGFIIPRPKTPIWWRWYCWICPVAWTLYGLVVSQFGDIMTPMDDNRPVKVFVEDYFDFKHSWLGWVAAVVVAFTVLFATLFAFAIMKLNFQKR

SEQ ID NO: 715 - protein, 1449 aa, Panicum virgatum
MDAGGDIQKAMSMRRGDSGSFWRRGEDVFSRSSREEDDEEALRWAALEKLPTYDRVRRALVPSDLGLDDGAEAGGGRGLVDVDVLSLGPQQRRALLERVVRIADEDNERFLLKLKDRIERVGIDMPTIEVRFHNLEAEAEVRVGSSGLPTVLNSIVNTIEEAANALHLLPSRKRPMPILHDVSGIIKPRRLTLLLGPPGSGKTTFLLALAGRLDKSLKTKGKVTYNGHEMTEFVPERTAAYISQHDLHIGEMTVRETLAFSARCQGVGSRFDMLTELSRREKAANIKPDADIDAFMKASAMGGQEANVVTDYILKILGLDICADTMVGDEMLRGISGGQRKRVTTGEMLVGPSRALFMDEISTGLDSSTTFQIVNSLRQSIHILAGTAVISLLQPAPETYNLFDDIILLSDGQVVYQGPREDVLEFFESMGFRCPERKGVADFLQEVTSKKDQKQYWARRDEPYRFVPVKEFATAFKSFHTGRAIANELAVPFDKSKSHPAALTTTRYGVSGKELLKANIDREFLLMKRNSFVYIFRTFQLMVVSIIAMTLFFRTKMKHDTVADGGIYAGALFFGVLMIMFNGFTEMALTVFKLPVFFKQRDLLFFPAWAYTIPSWILKIPITFIEVGGYVFMTYYVIGFDPNVSRFFKHYLLLLAINQMSAAIFRFIGGIARNMIVANVFASFMLLVFMVLGGFILVREKIKKWWIWGYWISPMMYAQNAITVNEMLGHSWDKILDSTTSNETLGVQALKARGIFPEAKWYWIGFAAMIGYIFLFNALFTLALTYLKPYGNSRPSISEEELNEKHASMNGGVPDGNHLASKSSHQSTGINTDADSTLTEKGMILPFVPLSLTFDNIRYSVDMPQEMKAQGIQEDRLELLKGVSGSFRPGVLTALMGISGAGKTTLMDVLAGRKTGGYIEGDISISGYPKRQETFARISGYCEQNDIHSPQVTVYESLLFSAWLRLPEDVDSNKRKLFIEEVMELVELKQLRHALVGLPGVNGLSTEQRKRLTIAVELVANPSIIFMDEPTSGLDARAAAIVMRAVRNTVNTGRTVVCTIHQPSIDIFEAFDDLFLMKRGGEEIYAGPLGHHSSELIKYLEGIQGVSKIKDGYNPATWMLEVTTAAQEHVLGVDFSDIYKKSELYQRNKALIKELSQPAPGSSDLYFPTKYPRSSITQCIACLWKMNLSYWRSPPYNTVRFFFTTIIALLLGTIFWDLGGKVRTSQDLMNAMGSMYAAVLFIGVMNCTSVQPMVAVERTVFYRERAAGMYSAFPYAFGQIVIELPYALAQDVVYGLIVYSMIGFEWTVAKFFWYLFFGYFTLLYFTFYGMMAVGITPNAHIAAIISSAFYAIWNLFSGFIVPRPKVPIWWRWYCWVCPVAWTLYGLVVSQFGDVTTEMDDGTTVKAFIEDYFDFKHSWLGLVAAVVVGFTVLFGSLFGFAIMKLNFQKR

SEQ ID NO: 716 - protein, 1451 aa, Setaria italica
MDAMADIQKVVSMRRGDSGSMWRRGDDVFSRSSRDEDDEEALRWAALEKLPTYDRVRRAIVPLGLGGDGAEAAGGGKGFVDVDVLSLGPQQRRALLERLVRVADEDNERFLLKLKDRVDRVGIDMPTIEVRFHNLEAEAEVRVGSSGLPTLLNSVVNTVEEVANALHLLPSRKQTMPILHDVSGIIKPRRLTLLLGPPGSGKTTFLLALAGRLDKDLKTKGKVTYNGHEMTEFVPERTAAYISQHDLHIGEMTVRETLAFSARCQGVGSRLDMLTELSRREKAANIKPDADIDAFMKASAMGGQDANVVTDYIMKILGLDICADTMVGDEMLRGISGGQRKRVTTGEMLVGPARALFMDEISTGLDSSTTFQIVTSLRQSIHILGGTAVISLLQPAPETYNLFDDIILLSDGQVVYQGPREDVLEFFESMGFRCPERKGVADFLQEVTSKKDQKQYWARRDEPYRFVPVTKFATAFKSFRTGRAIANELAVPFDKSKSHPAALTTMRYGVSGKELLKANIDREILLMKRNSFVYIFRTFQLMVVSIIAMTVFFRTKMKHDSVADGALYMSALFFGVLMIMFNGFSEMALIVFKLPVFFKQRDLLFFPAWAYTIPSWILKIPITFIEVGGYVFLTYYVIGFDPNVGRFFKHYLLLLAINQMSASIFRFVGGVARSMTIANVFASFMLLVFMVLGGFILVRDKIKKWWIWGYWISPMMYAQNAISVNEMLGHSWDKILDSAASNETLGVQTLKFRRVFPEPKWYWIGFGAMIGYILLFNGLFTLALTYLKPFGKSRPSVSEEELKEKHASMTGGVPDDNHLASESSHLSTGINTETDSALTEKGMILPFVPLSLTFDNIRYSVDMPQEMKAQGVIEDRLVLLKGVSGSFRPGVLTALMGVSGAGKTTLMDVLAGRKTGGYIEGDISISGYPKKQETFARISGYCEQNDIHSPQVTVYESLLFSAWLRLPGDVDLDKRKIFIEEVMELVELKQLRDALVGLPGVNGLSTEQRKRLTIAVELVANPSIIFMDEPTSGLDARAAAIVMRAVRNTVNTGRTVVCTIHQPSIDIFEAFDDLFLMKRGGEEIYAGPLGHHSSELIKYFEGIQGVSKIKEGYNPATWMLEVTTASQEHVLGVDFSDIYKNSELYQRNKALIKELSQPAPGSSDLYFPSKYPRSSITQCMACLWKQNLSYWRNPPYNTIRFFFTTVIALLLGTIFWDLGSKVLTTQDLTNAMGSMYAAVLFIGIMNCTSVQPMVAVERSVFYRERAAGMYSAFPYAFGQIVIELPYTLAQDIVYGLIVYSMIGFEWTVAKFFWYLFFAYFTLLYFTFYGMMAIGITPNAHIGAIVSSAFYAIWNLFSGFIIPRPRMPIWWRWYCWVCPVAWSLYGLVVSQFGDVMTVMQDSDGRTVKAYIEDTYGFKHSWVGWVGAVVVGFAVLFGALFGFAIMKLNFQKR

SEQ ID NO: 717 - protein, 1450 aa, Brachypodium distachyon
MDAAAEIQKVASMRGDSGSIWRRGDDVFSRSSRDEDDEEALRWAALEKMPTYDRVRRAILPRLDGGGDEGAAAGKGVVDVDVHGLGPRERRALLERLVRVADEDNERFLFKLKDRLERVGIDMPTIEVRFEHLVASAEVRVGDSGLPTVLNSITNTLEEAANALRILPNRKRTMPILHDVSGIIKPRRMTLLLGPPGSGKTTLLLALAGRLDKDLKVSGNVTYNGHGMEEFVPERTAAYISQHDLHIGEMTVRETLAFSARCQGVGNRFDMLTELSRREKAANIKPDADIDAFMKASSMGGLEANVNTDYILKILGLEICADTMVGDEMLRGISGGQRKRVTTGEMLVGPAKALFMDEISTGLDSSTTFQIVNSLRQSVHILGGTAVISLLQPAPETYNLFDDILLLSDGQVVYQGPRENVLEFFESMGFKCPERKGVADFLQEVTSRKDQKQYWARVDEPYRFVPVKDFVSAFRSFHTGRAITNELAVPFDKSKSHPAALTTTRYGVSGTELLKANIDREILLMKRNSFVYMFRTFQLILMSFISMTLFFRTSMKRDSVTSGGIYMGALFFGVLMIMFNGFSELALTVFKLPVFFKQRDLLFYPAWAYAIPSWILKIPITFIEVGGYVFITYYVMGFDPNVGRFFKQYLLMLAINQMAASLFRFIGGAARSMIVANVFASFMLLIFMVLGGFILVREKVKKWWIWGYWISPLMYAQNAISVNELLGHSWDKILNSTASNETLGVQVLKSRGVFPEAKWYWIGLGAMLGFTLLFNALFTLALTYLKAYGNSRSSVSEDELKEKHANLNGEVLDNNHLETHGPSGISTGNDSAVVEDSSPVKRGMVLPFLPLALTFENIRYSVDMPPEMKTQGVVEDRLELLKGVSGSFRPGVLTALMGVSGAGKTTLMDVLAGRKTGGYIEGNISISGYPKKQETFARVSGYCEQNDIHSPQVTVYESLLFSAWLRLPGDVDLNKRKMFIEEVMELVELKPLRDALVGLPGVNGLSTEQRKRLTIAVELVANPSIIFMDEPTSGLDARAAAIVMRTVRNTVDTGRTVVCTIHQPSIDIFEAFDELFLMKRGGEEIYAGPLGHHSSELIEYFEGIHGVGKIKDGYNPATWMLEVTTTGQEQMLGVDFSDIYKKSELYQRNKALIKELSQPAPGSSDLYFPTQYSQSSITQCVACLWKQNLSYWRNPPYNAVRFLFTTVIALLFGTIFWDLGGKMSQSQDLFNAMGSMYAAVLFIGVMNCTSVQPVVAVERTVFYRERAAGMYSAFPYAFGQVVIELPYTLVQATVYGVIVYAMIGFEWTAPKFFWYLFFMYFTLLYFTFYGMMAIGLTPNYHIASIVSSAFYAIWNLFSGFIIPRPKTPIWWRWYCWVCPVAWTLYGLVVSQFGDVVTPMDDGTLVKDFIEDYFDFKHSWLGYVATVVVAFTLLFAFLFGFAIMKLNFQKR

SEQ ID NO: 718 - protein, 1454 aa, Aegilops tauschii
MDATAEIHKVASMRRDSGSIWRRGDDVFSRSSRDEDDEEALRWAALEKLPTYDRVRRAILPPLDGGEGAAPGAAAGKGVVDVHGLGPRERRALLERLVRVADEDNERFLLKLKDRLERVGIEMPTIEVRFEHLVAEAEVRVGNSGLPTVLNSITNTLEEAANALRILPNRKRTMPILHDVSGIIKPRRMTLLLGPPGSGKTTLLLALAGRLDKDLKVSGNVTYNGHGMEEFVPERTAAYISQHDLHIGEMTVRETLAFSARCQGVGTRFDMLTELSRREKAANIKPDADIDAFMKASSMGGLEANVNTDYILKILGLEMCADTMVGDEMLRGISGGQRKRVTTGEMLVGPAKALFMDEISTGLDSSTTFQIVNSLRQSVHILGGTAVISLLQPAPETYNLFDDIILLSDGQVVYQGPRDDVLEFFESVGFKCPERKGVADFLQEVTSKKDQKQYWVRGDESYRFVPVKDFVRAFQSFHTGRAIRKELAVPFDKSKSHPAALTTTRYGVSGTELLKANIGREILLMKRNSFVYMFRTFQLILMSFIAMTLFFRTKMKRDSVTNGGIYMGALFFGVLMIMFNGFSELALTVFKLPVFFKQRDLLFYPAWAYTIPSWILKIPITFVEVGGYVFITYYVMGFDPNVGRFFKQYLLMLAINQMAASLCRFIGGAARNMIVANVFASFMLLIFMVLGGFILVREKVKKWWIWGYWISPLMYAQNAISVNEFFGHSWDKILNSTASNETLGVQVLKYRGVFPEAKWYWIGLGAMLGYTLLFNALFTLALTYLKAYGNSRSSVSEDELKEKHANLNGEVLDNDRMLSPSNDGPIRMNTGNDSAIVEENSSPMQRGMVLPFLPLSLTFDNIRYSVDMPLEMKAQGVVEDRLELLKGVSGSFRPGVLTALMGVSGAGKTTLMDVLAGRKTGGYIQGNISISGYPKKQETFARVSGYCEQNDIHSPQVTVYESLLFSAWLRLPEDVDSNKRRMFIEEVMELVELKPLKDALVGLPGVNGLSTEQRKRLTIAVELVANPSIIFMDEPTSGLDARAAAIVMRTVRNTVDTGRTVVCTIHQPSIDIFEAFDELFLMKRGGEEIYAGPLGHHSADLINYYEGIHGVSKIKDGYNPATWMLEVTTIGQEQMLGIDFSDIYKKSELYQRNKALIKEQSQPAPGSTDLYFPTQYSQSSITQCMACLWKQNLSYWRNPPYNAVRFLFTTVIALLFGTIFWDLGGKMSQSQDLFNAMGSMYAAVLFIGIMNCTSVQPVVAVERTVFYRERAAGMYSAFPYAFGQVVIELPYTLAQATVYGVIVYSMIGFEWTAPKFFWYLFFMYFTLLYFTFYGMMAVGLTPNYHIASIVSSAFYAIWNLFSGFIIPRPKVPIWWRWYCWVCPVAWTLYGLVVSQFGDVTTPMEDGTPVKDFIEGYFDFKHSWLGYVATVVVAFAVLFAFLFGFAIMKLNFQKR

SEQ ID NO: 719 - protein, 1457 aa, Oryza sativa
MDAAGEIQKVASMRLGGSMRGDSGSMWRRGDDVFSRSSREEDDEEALRWAALEKLPTYDRVRRAILPLGGDDGAGDGGGKGVVDVHGLGPRERRALLERLVRVADEDNEKFLLKLKDRVDRVGIDMPTIEVRFEHLEAEAEVRVGNSGLPTVLNSITNTLEEAGNALGILPNRKQTMPVLHDVSGIIKPRRMTLLLGPPGSGKTTLLLALAGRLGKDLKASGKVTYNGHGMEEFVPERTAAYISQHDLHIGEMTVRETLAFSARCQGVGSRFDMLTELSRREKAANIKPDADIDAFMKAAAMGGQEANVNTDYILKILGLEICADTMVGDEMLRGISGGQRKRVTTGEMLVGPARALFMDEISTGLDSSTTFQIVNSLRQTVHILGGTAVISLLQPAPETYNLFDDIILLSDGQIVYQGPREDVLEFFESMGFKCPDRKGVADFLQEVTSKKDQRQYWARHDKPYRFVTVKEFVSAFQSFHTGRAIANELAVPFDKSKSHPAALATTRYGAPGKELLKANIDREILLMKRNSFVYMFRTFQLMVVSLIAMTLFFRTKMKRDSVTSGGIYMGALFFGVLMIMFNGFSELALTVFKLPVFFKQRDLLFYPAWSYTIPSWILKIPITFIEVGGYVFLTYYVIGFDSNVGSFFKQYLLMLAINQMAGSLFRFIGGAARNMIVANVFASFMLLIFMVLGGFILAREQVKKWWIWGYWISPMMYAQNAISVNELMGHSWNKIVNSSASNETLGVQVLKSRGVFPEARWYWIGFGAMIGFTILFNALFTLALTYLRPYGNSRQSVSEEELKEKRANLNGEIVGDVHLSSGSTRRPMGNGTENDSTIVDDDTEVTQRGMVLPFTPLSLSFDNVRYSVDMPQEMKAQGVADDRLELLKGVSGSFRPGVLTALMGVSGAGKTTLMDVLAGRKTGGYIEGSINISGYPKKQETFARVSGYCEQNDIHSPQVTVYESLLFSAWLRLPEDVDSNTRKMFIEEVMELVELKSLRDALVGLPGVNGLSTEQRKRLTIAVELVANPSIIFMDEPTSGLDARAAAIVMRTVRNTVNTGRTVVCTIHQPSIDIFEAFDELFLMKRGGEEIYAGPLGHHSSELIKYFESIPGVSKIKDGYNPATWMLEVTTIGQEQALGVDFSDIYKKSELYQRNKALIKDLSQPAPDSSDLYFPTQYSQSSLTQCMACLWKQNLSYWRNPPYNAVRFFFTTVIALLFGTIFWDLGGKVTKSQDLFNAMGSMYAAVLFIGVMNCTSVQPVVAVERTVFYRERAAGMYSAFPYAFGQVVIEIPYTLVQATVYGIIVYAMIGFEWTAAKFFWYLFFMVFTLLYFTFYGMMAVGLTPNYHIASIVSSAFYAIWNLFSGFVIPRPRVPIWWRWYCWACPVAWTLYGLVVSQFGDIETPMEDGTPVKVFVENYFGFKHSWLGWVATVVAAFAFLFASLFGFAIMKFNFQKR

SEQ ID NO: 720 - protein, 1458 aa, Setaria italica
MDAAAEIQKVASMRLDGGLRSGSSSAWWRAPDVFSRSSSRREDGDDEEEALRWAALERLPTCDRVRRAILPLGEGGETGAHAQQVVDVLGLGPRERRALLERLVRVADEDNERFLLKLKERVERVGIDMPTIEVRFEHLKAEADVRVGTSGLPTVLNSITNTLEEVASALRVHRSRKQAMPILHDVSGIVKPRRMTLLLGPPGSGKTTLLLALAGRLDKDLKVSGKVTYNGHGMDEFVPERTAAYISQHDLHIGEMTVRETLEFSARCQGVGSRFDMLTELSRREKVGNIKPDADIDAFMKACAMRGQEANVISDYILKILGLDICADTMVGDEMLRGISGGQRKRVTTGEMLVGPANALFMDEISTGLDSSTTFQIIKSLRQAIHILGGTALISLLQPAPETYDLFDDIILLSDGQIVYQGPREGVLEFFWSLGFKCPERKGVADFLQEVTSRKDQKQYWGRHNKPYQYVSVKEFACAFQSFHAGRAIANELAVPFDKSKNHPAALTTSRYGVSARELLKANIDREILLMKRNSFVYIFRTLQLMMVSTMAMTLFFRTKMHRDSVTDGRIYLGALFFAVIMIMFNGLSELALTIIKLPVFFKQRDLLFFPAWAYTIPTWILKIPISFLEVGGFVFMSYYVIGFDPNVGRFFKQYLLLLAVNQMAASLFRFVGGAARNMIVANVFGSFMLLIFMVLGGFILVRDKVKKWWIWGYWISPLMYAQNAISVNEMLGHSWDKIMNSSVSNETLGVQSLKSRGVFPEAKWYWIGLGALLGFVMLFNCLFTLALAYLKPYGESHPSISEEELKEKYANLKGNALAEDSLALGSSHRATVGITGSGSATAENHSCTRGMVLPFAPLSLTFNNIKYFVDMPQEMKTHGVVEDRLELLKGVSGSFRPGVLTALMGVSGAGKTTLMDVLAGRKTSGYIEGNIRISGYPKKQKTFARVSGYCEQNDIHSPQVTVYESLLFSAWLRLPKDVDSNTRKMFIEEVMELVELKPLRNALVGLPGVNGLSTEQRKRLTIAVELVANPSIIFMDEPTSGLDARAAAIVMRTVRNTVDTGRTVVCTIHQPSIDIFEAFDELFLMKRGGEEIYVGPLGHRSSELIKYFEGIQGVRKIKDGYNPATWMLEVTTVSQEQTLGVDFSDLYKKSELYQRNRALIQELSEPPAGSSDLHFRNQYSQSFFMQCLACLWKQNLSYWRNPAYNAVRLFFTTIIALIFGTIFWDLGGKMGQPQDLSNAMGSMYAAVLFIGVLNAMSVQPVVSVERTVFYRERAAGMYSALPYAFGQVTIELPYTLAQASVYGIIVYSMIGFEWTAAKFFWYLFFMYFTFLYFTFYGMMAVGLTPSYHVASIVSSAFYAIWNLFSGFIIPRPKVPIWWKWYCWACPVAWTLYGLVVSQFGDITTAMDNGVPVNVFVEKYFGFKHSWLGVVAAVVVAFAVLFACLFGFAIMKLNFQRR

SEQ ID NO: 721 - protein, 1292 aa, Panicum virgatum
MDAAGEIQKVASMRLGNSGSIWRRGDDVFSRSSRDEDDEEALRWAALEKLPTYDRVRRAMVPLGGDGAEAGAGGGKGLVDVHSLDPQQRRALLERLVRVADEDNERFLLKLKDRVDRVGIDMPTIEVRFQNLEAEAEVRVGSSGLPTVLNSIINTVEETANALHLLPSRKQTMPILHDVSGIIKPRRLTLLLGPPGSGKTTLLLALAGRLAKDLKVSGKVTYNGHEMTEFVPERTAAYISQHDLHIGEMTVRETLAFAARCQGVGSRFDMLTELSRREKAANIKPDADIDAFMKASAMGGKDASVVTDYMLKILGLEVCADTMVGDEMIRGISGGQRKRVTTGEMLVGPARALFMDEISTGLDSSTTFQIVNSLRQSIHILGGTAVISLLQPAPETYNLFDDIILLSDGQVVYQGPREEVIEFFESMGFRCPERKGVADFLQEVTSKKDQKQYWARRDEPYRFVTVKEFAMAFKSFHTGRTIENELAVPFDKSKSHPAALTTTRYGVSGKELLKANIDREILLMKRNSFVYMFRTFQLMLMSILSMTLFFRTKMKHDSVIDGGLYMGALFFGVLLIMFNGFSEMAMTVFKLPVFFKQRDLLFFPAWSYTIPSWILKIPITFIEVAGYVFLTYYVIGFDPNISRFFKQYLLLLAINQMAAALFRFIGGAARSMVVANVFASFMLLVVMVLGGFILVREKIKKWWIWGYWISPMMYAQNAISVNEMLGHSWNKILNSTASNETLGVQTLKSRGVFPEAKWYWIGFGAMIGFTIFFNAIFTLALTYLKPYGDSRPSVSEEELKEKHANMKGEVLDGNHRASASSHRPTGINTEADPAIAEDDSALTKRGMILPFVPLSLAFDNIRYSVDMPQEMKAQGVQEDRLELLKGVSGSFRPGVLTALMGVSGAGKTTLMDVLAGRKTGGYIEGDISISGYPKKQETFARISGYCEQNDIHSPQVTVYESLLFSAWLRLPKDVDSNKRKIFVEEVMELVELKPLRDALVGLPGVNGLSTEQRKRLTIAVELVANPSIIFMDEPTSGLDARAAAIVMRTVRNTVDTGRTVVCTIHQPSIDIFEAFDELFLMKRGGEEIYAGPLGHHSSELIKYFEGIQGVSKIKDGYNPATWMLEVTAVSQEQILGVDFSEMYKKSELFQRNKALIKELSQPAPGSSDLYFPSKYAQSSITQCMACLWKQNLSYWRNPPYNTVRFFFTTVIALLLGSIFWDLGGKVKTSQDLLNAMGSMYSAVLFIGVMNCTSVQPVVAVERTVFYRERAAGMYSAFPYAFGQVVIELPYAL

SEQ ID NO: 722 - protein, 1464 aa, Oryza sativa
MDAAAEMQKVVSLRRGGGGSSSRGAASMWWSADNGVFSRSRASSSGEDGEDDEEALRWAALEKLPTYDRVRRAVLPVVEEGGGGGEAGKKVVDVLSLGPQERRALLERLVRVAEDDNERFLLKLKERIDRVGIDIPTIEVRFEHLEAEAEVRVGNSGLPTVLNSMTNKLEGAANALGILPNKKQTMPILHDVSGIVKPRRMTLLLGPPGSGKTTLLLALAGRLGKDIKFSGQVTYNGHQMEDFVPQRTAAYISQHDLHIGEMTVRETLSFSARCQGVGSRFDMLTELSRREKAANIKPDADIDAFMKASAMEGQETNLITDYILKILGLDICADTMVGDDMVRGISGGQRKRVTTGEMLVGPANALFMDEISTGLDSSTTFQIVKSLRQAIHILGGTAVISLLQPAPETYDLFDDIILLSDGQIVYQGPREGVLEFFELMGFKCPERKGVADFLQEVTSRKDQKQYWMQHDKPYRYVPVKDFASAFQSFHTGKSIANELATPFDKSKNHPAALTTSRYGVSAMELLKANIDREFLLMKRNSFVYIFRACQLMVVSAIAMTVFFRTKMHRDSVTDGVIFMGALFFSVMMIMFNGLSELPLTIFKLPVFFKQRDLLFFPAWTYTIPSWILKIPMSFIEVGGFVFMSYYVIGFDPSAGRFFKQYLLMLAINQMAAALFRFVGGAARNMIVANVFGSFMLLIFMVLGGFILVREKVKKWWIWGYWISPMMYAQNAISVNEFLGHSWDKVLNNSLSNETLGVQALRSRGVFPEAKWYWIGFGALLGFIMLFNGLFTLALTYLKPYGKSQPSVSEEELKEKQANINGNVLDVDTMASSTNLAIVDNTETSSEIADNSQPTQRGMVLPFAPLSLTFDNIKYSVDMPQEMKAHGIVEDRLELLKGVSGSFRPGVLTALMGVSGAGKTTLMDVLAGRKTGGYIEGNITISGYPKKQETFARVSGYCEQNDIHSPQVTVSESLLFSAWLRLPKDVDSNTRKMFIEEVMELVELKPLRDALVGLPGVNGLSTEQRKRLTIAVELVANPSIIFMDEPTSGLDARAAAIVMRTVRNTVDTGRTVVCTIHQPSIDIFEAFDELFLMKRGGEEIYVGPLGHQSSELIKYFEGIKGVSRIKDGYNPATWMLEVSTISQEQALGVDFCDIYRKSELFQRNKALIQELSTPPPGSSELYFPTKYSLSFLNQCLACLWKMHLSYWRNPPYNAIRLFFTTVIALLFGTIFWDLGGKTGKSQDLFNAMGSMYSAVLFIGVLNSQSVQPVVSVERTVFYRERAAGMYSAFPYAFGQVAIEFPYTLVQSIIYGIIVYSMIGFKWTAAKFFWYLFFMFFTFLYFTFYGMMAVGLTPSYHVASIVSSAFYGIWNLFSGFIIPRPKVPIWWRWYCWICPVAWTLYGLVASQFGDIMTPMDDGTPVKIFVENYFDFKHSWLGVVAVVIVAFTMLFAFLFGFAIMKLNFQKR

SEQ ID NO: 723 - protein, 1463 aa, Sorghum bicolor
MDAAAELQKVASMRRDSGGSRSGSSAWWRAPDAFSRSSSRMEEDDEEALRWAALERLPTCDRVRRAILPLGGNGDGHGHGGGDAATQVVDVLGLGPRERRALLERLVRVADEDNERFLLKLKERVERVGIDMPTIEVRFKHLRAEADVRVGTSGLPTVLNSITNKLEEVANALHVRRSRKQAMPILHDVSGIVKPRRMTLLLGPPGSGKTTLLLALAGRLDKDLKVSGKVTYNGHEMDEFVPERTAAYISQHDLHIGEMTVRETLEFSARCQGVGTRFDMLTELSRREKVGNIKPDADIDAFMKACAMRGQEANVISDYILKILGLEICADTMVGDDMLRGISGGQRKRVTTGEMLVGPANALFMDEISTGLDSSTTFQIIKSLRQAIHILGGTALISLLQPAPETYDLFDDIILLSDGQIVYQGPRESVLEFFLSLGFKCPERKGVADFLQEVTSRKDQKQYWVWHDKPYRYVSVKEFATAFQCFHVGRAIANELAIPFDKSKNHPAALTTSKYGVSAWELFKANIDREMLLMKRNSFVYIFRTLQLMTVSIIAMTLFFRTKMHRDSVTDGGIYLGALFFAVIMIMFNGLSELALTIIKLPVFFKQRDLLFFPAWAYTIPTWILKIPISFVEVGGFVFMAYYVIGIDPNVGRFFKQYLLLLALNQMAASLFRFVGGAARNMIVANVFGSFMLLIFMVLGGFILVRDKVKKWWIWGYWISPLMYAQNAISVNEMLGHSWDKILNSSVSYETLGVQSLKSRGVFPEAKWYWIGLGALLGFVMLFNCLFTLALAYLKPYGKSHPSISEEELNEKYANLNGNVVAEDNLPPGSSYLAAVDITRSDSATIENHSGTMQRGMVLPFAPLSLTFSNIKYFVDMPQEMKTHDVVGDRLELLKCVSGSFRPGVLTALMGVSGAGKTTLMDVLAGRKTSGYIEGNISISGYPKKQETFARVSGYCEQNDIHSPQVTVYESLVFSAWLRLPSDVDLNTRKMFIEEVMELVELKPLRNALVGLPGVNGLSTEQRKRLTIAVELVANPSIIFMDEPTSGLDARAAAIVMRTVRNTVDTGRTVVCTIHQPSIDIFEAFDELFLMKRGGEEIYVGPLGHHSSELIKYFEGIHGVKKIKDGYNPATWMLEVTTISQEEILGVDFSDLYKKSELYQRNKALIQELSEPSVGSTDLHFRNQYSQSFFMQCLACLWKQNLSYWRNPAYNAVRLFFTTIIALIFGTIFWDLGGKMGQSQDLFNAMGSMYAAVMFIGVLNATSVQPVVSVERTVFYRERAAGMYSALPYAFGQVTIELPYTLTQATVYGIIVYSMIGFEWTVAKFFWYLFFMYFTFLYFTFYGMMAVGLTPSYHVASIVSSAFYGIWNLFSGFIIPRPKVPIWWKWYCWACPVAWTLYGLVVSQFGDITMPMDNGVPVNVFVENYFGFKHSWLGVVAAVVMAFTIFFASLFGFAIMKLNFQRR

SEQ ID NO: 724 - protein, 1449 aa, Setaria italica
MDLAGEIQRVVSMRRDSGGSVWRSRNDAFSRSSREADRVDDEEALRWAALEKLPTRDRVRRAILVPPGDDEGQGVMDVDVLSLGPGERRALLERLVRVADEDHERFLVKLRERLERVGIDMPTIEVRFEHLDVEAEVRVGSSGLPTVVNSITNTIEEAATALRLLRSRKRKMPVLHDVSGIIKPRRMTLLLGPPGSGKTTLLLALAGRLDKDLRVSGRVTYNGHGMEEFVPERTAAYISQHDLHIAEMTVRETLAFSARCQGVGSRFDMLMELSRREKAANIKPDADIDAFMKASAVGGHEANVVTDYILKILGLELCADTMVGDELLRGISGGQRKRVTTGEMLVGPARALFMDEISTGLDSSTTFQIVNSLRQSIHVLGGTAVISLLQPAPETYNLFDDIILLSDGQVVYQGPREDVVGFFESMGFRCHERKGVADFLQEVTSRKDQKQYWAEPDKPYRFVPAKEFATAFKSFHTGMALAKELSVTFDKSKSHPAALTTTRYGVSAKALLKANIDREILLMKRNSFIYMFRTFQLTLMSLIAMTVFFRTKMKRDSVTSGGIFMGAMFFGILMIMYNGFSELALTVLRLPVFFKQRDLLFYPAWSYTVPSWILKFPVTLMEVSGYVFVTYYVIGYDPNVGRFFKHYLIMLAINQVAASLFRLIGGAARNMIIANVFAMLIMMTFMVVNGFILVRDDVKKWWIWGYWISPLMYVQNAITVNEFLGHSWDKILNSTVSNETLGVQVLKSHGVFPEARWYWIGFGALLGFTALFNVLFTLALTCLRPYGNPRPSVSEEVLKQKQSNVKNGIPDATPWASVQPIGDNTETNLEMSEDDCGPTQKGMVLPFLPLSLSFDDIRYSVDMPQEMKAQGVADDRLALLKGVSGSFRPGVLTALMGVSGAGKTTLMDVLAGRKTGGYIEGNISISGYLKNQETFARVTGYCEQNDIHSPQLTVRESLLFSAWLRLPKDVDSNTRKMFIEEVMELVELKPLRDAFIGLPGINGLSTEQRKRLTIAVELVANPSIIFMDEPTSGLDARAAAIVMRTVRNTVDTGRTVVCTIHQPSIDIFEAFDELFFMKPGGEEIYVGPLGHNSSELIKYFQGIQGVSKIKDGYNPATWMLEVTTVSQEQILGVDFSDIHRKSELYQRNKALIKELSQPAPGSSDLYFPTKYSQPSFTQCMACLWKQNLSYWRNPPYNAVRIIFSTVTALLFGTVFWDLGGKVKRQQDLINALGSMYAAVLFLGVSNSISVQPVVAVERTVFYRERAAGMYSFFPYAFGQVVIELPYALVQATVYGVIVYAMIGFEWTAAKFFWYLFFMYFTLLYFTFYGMMCVGLTPNYNIASIVSTAFYNIWNLFSGFFIPRPRTPIWWRWYCWVCPIAWTLYGLVVSQYGDITTPMEDGRPVKVFLEDYFDFKHSWLGWAAAVVVAFSVLFAALFAFAIMKLNFQKR

SEQ ID NO: 725 - protein, 1461 aa, Sorghum bicolor
MDPSGEIRKVASMRRDSGGSVWRSGGNDIFSRSSRRDDDMDDEEALRWATLEKLPTRDRVRRAIIFPLPPAGAAGTTTGQQQGLVDVDVLSLGPGERRALLERLVRVADEDHERFLVKLRERLDRVGIDMPTIEVRFEHLNVEAEVRVGSSGIPTVLNSITNTLEEAATALRILRSRKRALPILHDVSGIIRPRRMTLLLGPPGSGKTTLLLALAGRLDKDLKVSGRVSYNGHGMEEFVPQRTAAYISQHDLHIAEMTVRETLAFSARCQGVGSRFDMLMELSRREKAANIKPDADIDAFMKASAVGGHEANVVTDYILKILGLELCADTMVGDEMLRGISGGQRKRVTTGEMLVGPARALFMDEISTGLDTSTTFQIVNSLRQSIHVLGGTAVISLLQPGPETFNLFDDIILLSDGQVVYQGPREDVIEFFESMGFRCPQRKGVADFLQEVTSKKDQKQYWAWSDKPYRFVPAKEFATAHKLFHTGRALAKDLAMPFNKNKSHPAALTTTRYGVSGMELLKANIDREILLMKRNSFIYVFRTFQLTLMSIIAMTVFFRTNMKHDSVASGGIYMGAMFFGILMIMYNGFSELALTVFRLPVFFKQRDLLFYPAWAYTIPSWILKIPISFMEVSGYVFLTYYVIGYDPNVGRFFKQYLIMLAINQLAASLFRFIGGAARNMIVANVFAMLVMMAAIILNGFIIIRDKVKKWWIWGYWISPLMYVQNAITVNEMLGHSWDKVLNRTISNETLGVQVLKSHGVFPEAKWYWIGFGALLGFTILLNVVFTFALTYLKPNGNPKPSISEEELKLKCSNVNNDIMDANPLASRTTLQLIGNNTETNLEMLEDNSGPSQRGMVLPFPPLSLSFDDIRYSVDMPQEMKAQGVVEDRLILLKGISGSFRPGVLTALMGVSGAGKTTLMDVLAGRKTGGYVEGNISISGYLKNQETFARVSGYCEQNDIHSPQVTVDESLLFSAWLRLPKDVDSNTRKMFIEEVMELVELKPLRDALVGLPGVNGLSTEQRKRLTIAVELVANPSIIFMDEPTSGLDARAAAIVMRTVRNTVNTGRTVVCTIHQPSIDIFEQFDELFLMKRGGEVIYAGPLGHNSLELIKYFEAIEGVSKIKDGYNPATWMLEVTTVSQEHVLGVDFSDIYKKSELYQRNKDLIKELSQPAPGSRDLYFPTKYSQSSFTQCMACIWKQNMSYWRNPPYNTARFIFTTITALIFGTMFWNLGSKIDKSQDLFNALGSMYLSVIFLGCTNSISVQPVVAVERTVFYRERAAGMYSAFPYAFGQVVIELPYALVQASIYGVIVYAMIGFEWTAAKFFWYLFFMYFTLLYFTFYGMMGVGLTPNYQIASIVSTAFYNIWNLFSGFFIPRPKTPIWWRWYCWICPVAWTLYGLVVSQYGDITTPMEDGRTVNVFLEDYFDFKHSWLGRAAAIVVAFSVFFATLFAFATMKLNFEKR

SEQ ID NO: 726 - protein, 1464 aa, Panicum virgatum
MDAAAEIQKVASMRLDSGGSRSRSGSGSSAWWRAPADAFSGSLSRRGGDEDDEEALRWAALERLPTCDRVRRAILPLAAEGAEAGAHQVVDVLSLGPHERRALLERLVRVADEDNERFLLKLKDRVERVGIDMPTIEVRFEHLKAEAEVRVGTSGLPTVLNSITNKLEEVASALRVRRSRKQAMPILHDISGIVKPRRMTLLLGPPGSGKTTLLLALAGRLDKDLKVSGKVTYNGHGMDEFVPERTAAYISQHDLHIGEMTVRETLEFSARCQGVGSRFDMLTELSRREKVGNIKPDADIDAFMKACAMRGQEANVISDYILKILGLEVCADTMVGDEMLRGISGGQRKRVTTGEMLVGPANALFMDEISTGLDSSTTFQIIKSLRQAIHILGGTALISLLQPAPETYDLFDDIILLSDGQIVYQGPRESVLEFFLSLGFKCPERKGAADFLQEVTSRKDQKQYWARHDKPYQYVSVKEFACAFQSFHAGRAVANELAIPFDKRKNHPAALTTSRYGASARELLKATIDREILLMKRNSFVYIFRTLQMMMVSTIAMTLFFRTKMHRDSVTDGGIYLGSLFFAVMVIMFNGLSELALTIIKLPVFFKQRDLLFFPAWAYTIPTWVLKIPISFVEVGGFVFMAYYVIGFDPNVGRFFKQYLLLLAVNQMAASLFRFVGGAARNMIVANVFGSFMLLIFMVLGGYILVRDKVKKWWKWGYWISPLMYAQNAISVNEMLGHSWDKILNSSVSNETLGVQSLESRGVFPEAKWYWIGLGALLGFVMLFNYLFTLALAYLKPYGKSHPSISEEELKEKYANLNGNALAEDSLALGSTHRAIVSITGSGSATAENHSCTTQRGMVLPFAPLSLTFNNIKYFVDMPQEMKTHGVVEDRLELLKGVSGSFRPGVLTALMGVSGAGKTTLMDVLAGRKTSGYIEGNISISGYPKKQETFARVSGYCEQNDIHSPQVTVYESLLFSAWLRLPMDVDSNTRKMFIEEVMELVELKPLRNALVGLPGVNGLSTEQRKRLTIAVELVANPSIIFMDEPTSGLDARAAAIVMRTVRNTVDTGRTVVCTIHQPSIDIFEAFDELFLMKRGGEEIYVGPLGHHSSELIKYFEGIQGVRKIKDGYNPATWMLEVTTVSQEQILGVDFCDLYKKSELYQRNKALIQELSEPQAGSSDLHFSDRYSQSFFMQCLACLWKQNLSYWRNPAYNAVRLFFTTIIALIFGTVFWDLGGKMGQSQDLFNAMGSMYAAVMFLGVLNATSVQPVVSVERTVFYRERAAGMYSALPYAFGQVTIELPYTLAQATVYGIIVYSMIGFEWTATKFFWYLFFMYFTFLYFTFYGMMAVGLTPSYHIASIVSSAFYGIWNLFSGFIIPRPKVPIWWKWYCWACPVAWTLYGLIVSQFGDITTPMDDGVPVKVFVENYFGFKHSWLGLVAAMVVVFAVFFAFLFGFAIMKLNFQRR

SEQ ID NO: 727 - protein, 1464 aa, Sorghum bicolor
MNAAAELQKVATSMRGNSGGSGSGRPSAWWRAPDDAFSRSSSRREEEDDEEALRWAALERLPTCDRIHRAILPLGGGDCDGGGEAAPQVVDVLGLGPRERRALLERLVRVADEDNERFLLKIKERVERVGIDMPTIEVRFEHLSAEADVRVGSSGLPTVLNSITNKLEDVANALHVRRSRKQAIPILHDVSGIVKPRRMTLLLGPPRSGKTTLLLALAGRLDKDLKVSGKVTYNGHEMDEFVPERTAAYISQHDLHIGEMTVRETLEFSARCQGVGTRFDLLAELSRREKAGNIKPDTDIDAFMKACSMRGQEANVICDYILKILGLEICADTMVGDEMWRGISGGQRKRVTTGEMLVGPANALFMDEISTGLDSSTTFQIIKSLRQAIHNLGGTALISLLQPAPETYDLFDDIILLSDGQIVYQGPRESVLEFFSSLGFKCPERKGVADFLQEVTSRKDQKQYWVRHDKPYQYVSVKDFASAFQSFHVGRAIANELVVPFDKCKNHPSSLTTSRYGVSSWELLKANIDREILLMKRNSFVYIFKTLQLMMMSIMGMTIFFRNKMHHDSVTDGGIYFGALFFTVITIMFNGFSELALTVIKLPVFFKQRDLLFFPAWACTIPTWILRIPISFVEVGGFVFMAYYVIGFDPNVGRFFKQYLLLLAFNQMATSLFRFVGGAARNMIIANVFGGFILLSFMVLGGFILVRDKVKKWWIWGYWISPLMYAQNAISVNEMLGHSWDKILNSSMSNETLGVQSLKSRGVFPEAKWYWIGLGALIGFVMLFNCLFTLALAYLKPYGKSHPSISEEELKVKYANLSGNVVAGGNLPLGSSHLETVGITRSGSATVENHSGTTQRGMVLPFARLSLTFNNIKYFVDMPQEMKTLGVVGDRLELLKGISGSFKPGVLTALMGASGAGKTTLMDVLAGRKTSGYIEGNISISGYPKKQETFARVSGYCEQNDIHSPQVTVYESLVFSAWLRLPKDVDSNTRKVFIEEVMELVELKPLRNALVGLPGVNGLSTEQRKRLTIAVELVANPSIIFMDEPTSGLDARAAAIVMRTVRNTVDTGRTIVCTIHQPSIDIFEAFDELFLMKPGGEEIYVGPLGHHSSELIKYFEGIDGVKKIKNGYNPATWMLEVTTISQEQILGVDFSDMYKKSELYQRNKALIQKLSEPSAGSSDLHFRNQYSQSFFMQCVACLWKQNLSYWRNPAYNAIRLFFTTIIALISGTVFWDLGGKMSQSQDLLNTMGSMYAAVMFIGILNAKSIQPVVFVERTVFYRERAAGMYSALPYAFGQVSIELPYTLAQATIYGVIVYSMIGFKWTVAKFFWYLFFMYFTFLYFTFYGMMAVGLTPSYPVASIVSSAFYNIWNLFSGFIIPRPKVPIWWNWYCWACPVAWTLYGLVVSQFGDITTPMDNGVPVNVFVEKYFGFKHSWLGVVAVVVVAFAIFFALLFGFAIMKLNHQRR

SEQ ID NO: 728 - protein, 170 aa, Zea mays
MDSKLGVQHGHRHHHSHNGVSKPPVARRRQSGGGGGKGVKVVYISSPMKLTASAEEFRAIVQELTGRDSNVADHDLDGGGAYHVGAPSSSSSSSSSYSSLGRVSPAVAEAAAAAAAGARARSSPATNAGGAPPVVEYAAAMAQPPPFQFQFQGMYDHQTAGSLLYGLDNW

SEQ ID NO: 729 - protein, 332 aa, Sorghum bicolor
MSSSSPPHVVEDMPHVLQLLSDGTVVRFADYDTLPPPSVPPALPVQWKDVVYDATHDLKLRVYRPPPDSCGNNKLPVLVYFHGGGYVLGTFALPNFHACCLRLAAELPAVVLSADYRLAPEHRLPAALDDAASVMDWVRAQAVDAAGGDPWLAESADLRRVFVTGDSAGGNIVHHVAVRLASASGELSPGLDPVRVAGHVMLCPFFGGAERTASEAEFPPGPFLTLPWYDQAWRLALPPGATRDHPFANPFGPESPALGGVALPPTLVVAAERDLLRDRQADYVARLKATEQPVEHVEFEGQHHGFFAVEPAGDAGSEVVRLVRRFVYGNSY

SEQ ID NO: 730 - protein, 328 aa, Setaria italica
MSSSSPPHVVEDLPHVLQLLSDGTVVRFDDYNTLPPPAVPPAPPVQWKDVVYDAAHGLKLRAYRPPDACGKLPVLVYFHGGGYVLGTFALPNFHACCLRLAGELPAVVLSADYRLAPEHRLPAALDDAAAVMSWVRLQAAAGGDPWLAESADFGRVFVAGDSAGGNIVHHVAVRLGSGELPGLGPASVAGHVMLCPLFGGVERTASEAELPPGPFLTLPFYDQIWRLALPRGATRDHPFVNPFGPESPALGGVALPPTLVVAAGRDLLRDRVADYAARLRAMGKPVELVVFEGQHHGFFVVEPFGEAASEVVRLIRRFVYGDGSADSK

SEQ ID NO: 731 - protein, 475 aa, Sorghum bicolor
MTGKKRTFVLYPSLGVGHLIPMVELAKHLLRHGHGALIAVVDPPDTDAVSAAAVARLAAANPAIAFRLLPAPASPDVVGVHPAKRDKDTLQLANPALRDLLRDSLPGAVDALLLDMFCVDALDVAAEVGVPAYFFFASAAGDLAVFLNLPYLYPTLPSSFREMGETLVRCPGMPTPIQALDMPWTVLDRESDGTKVRMYQWKRIAEARGVLVNSFDWLEPRALTALGDGVCVPGRPTPRVFCIGPLVNDGSTGQSGERHECLAWLDAQPKRSVVFLCFGSKGAFPAAQLQEIARGLESSGHRFLWVVRSPPEEEGQSPELDLGRLLPAGFLDRNRGRGMVVKNWVPQAQVVRHEAVGAFVTHCGWNSALEAIVSGLPMICWPLYAEQALNKVFMVEEMKIAVALGRYEEFVRAEEVEAKVRLVMEAEEGRILRERLAVAREKALEATRECGSSQVAFAEFLRDLDKSSSVNGECN

SEQ ID NO: 732 - protein, 469 aa, Setaria italica
MAKKTFVLYPSLGVGHLIPMVELAKHLLRHGIGALIAVVDPPDTDAVSAAAVARLAATNPAIAFRLLPAPASPDAGAHPVKRSLDTLRLANPALRGLLRSLPAVDALLLDMFCVDALDVAAELGVPAYFFFASAVGDLAVFLNLPYLYPTLPSFRDMGKTLVRCPGMPPIQALDMVITMQDKESDPTKVRLYQFRRIPEGSGVLVNSFDWLEPRALKALEDGVCVPGRPTPRVYCIGPLVNDGNKGENGEMHECLAWLDTQPERSVVFLCFGSKGAFSAAQLQEIAGGLESSGHRFLWAVRSPPEEHGQFPEPDLERLLLAGFLERTRGRGMVVKNWVPQAEVVRHEAVGAFVTHCGWNSALEAIMSGLPMICWPLYAEQGMNKVFMVEEMKIAVELQGYEELVKAEEVEAKVRLVMETEEGKILRERLAVAREKALEATKEGGSSEVAFAEFLRDLEKKSSYGNGKCR

SEQ ID NO: 733 - protein, 375 aa, Zea mays
MALMQESSSQDLLQAHDELLHHSLCFAKSLALAVALDLRIPDAIHHHGAGGATLLQILAETALHPSKLRALRRLMRVLTVTGIFSVVEQPPAGGGDDSTVHTSDDEAVVVYRLTAASRFLVSDDVSTATLAPFVSLALQPIAACPHALGISAWFRQEQHEPSPYGLAFRQTPTIWEHADDVNALLNKGMAADSRFLMPIVLRECGETFRGIDSLVDVGGGHGGAAATIAAAFPHLKCSVLDLPHVVAGAPSDGNVQFVAGNMFESIPPATAVFLKKTLHDWGDDECVKILKNCKQAISPRDAGGKVIILDVVVGYKQSNIKHQETQVMFDLYMMAVNGVERDEQEWKKIFTEAGFKDYKILPVIGDVSVIIEVYP

SEQ ID NO: 734 - protein, 378 aa, Zea mays
MALMQESSSQDQDMLQAHDELLHHSLCFAKSLALTVALDLRIPDAIHHHGGGATLLQIIAETGLHPSKLRALGRLMRVLTVTGTFSVQQPPAGSDDDEAVVVYRLTAASRFLVSDEVSTATTLAPFVSLALQPIAASPHALGICAWFRQEQHEPSPYGLAFRQTPTLWEHADDVNALLNKGMVADSRFLMPIVLRQCGEMFRGINSLVDVGGGHGGAAAAIAAAFPPLQEKPKISAHVKCSVLDLPHVVAGAPSDGNVQFVAGNMFESIPPATAVFLKKTLHDWGDDECVKILKNCKQAIPPRDAGGKVIILDVVVGYKQSNIKHQETQVMFDLYMMAVNGVERDEQEWKKIFAEAGFKDYKILPVIGDVSVIIEVYP

SEQ ID NO: 735 - protein, 366 aa, Zea mays
MALSTQDLLEAHVELWHQSLCYAKSLALAVALDLRIPDAIHHHGGSATLPQILAETAAHPSKLRALRRLMRVLTVSGTFSVEQQPPAGGDDSTVDAPDEAVYRLTAASRFLVSDEVSSSTLAPFVSLALHPIAVSPHTMGICAWFRQEQREPSPYGLAFQQTFPTIWEHADDVNALLNKGMVADSRFLMPIMLRECGEVFRGIESLVDVGGGHGGATAAIAAAFPHLKCSVLDLPHVVAGAPSDVNVQFVAGNMFQSIPPATAVFLKTTLHDWGDDECVKILKNCRQAISPRDAGGKVIILDMVVGYGQPNITHLETQVMFDLYIMTVNGAERDEQEWKKIFIEAGFKDYKILPILGALSVIEVYP

SEQ ID NO: 736 - protein, 366 aa, Zea mays
MALMQESSQDLLEAHDELFHHCLCFAKSLALAVAQDLRIPDAIHHHGGGATLHQILAETALHPSKLRALRRLMRVLTVSGVFTVQYSSTVDASDGADVVYRLTAASRFLVSDSDEAGTASLAPFANLALHPIAISPHAVGICAWFRQEQHDPSPYGLAFRQIPTIWEHADNVNALLNKGLLAESRFLMPIVLRECGDEVFRGIDSLVDVGGGHGGAAATIAAAFPHVKCSVLDLPHVVAGAPSDACVQFVAGNMFHSIPPATAVFFKTTLCDWGDDECIKILKNCKQAISPRDEGGKVIIMDVVVGYGQSNMKRLETQVMFDLVMMAVNGVERDEQEWKEMFIEAGFKDYKIRPVAGLMSVIEVYP

SEQ ID NO: 737 - protein, 329 aa, Zea mays
MASAGTTAVVPEVALRSGNARTAMPMVGMGTASFPLVHEAVKDGVLSAIEVGFRHFDTASMYGTEKPLGDAVAEALRRGTLRSREDLFVTSKLWCSQNHPDLVLPSLRETLKNLQMEYVDLYLIHWPVCLKPGPPELPTRKENAVPLDLAGVWRAMEECQRLGLAKAIGVSNFTTRHLDGVLAVATVPPAVNQVELNPAWQQRTLRAYCADRGIHVAAYSPLGGQNWDGQGSAVLDSEVLAAIAKARGKTVAQVALRWIHEQGVTCIVKSYSKERLRQNLGIFDWELTDEERLKISQIPQRKVVQTSSLFSQEGEFTAVDPAELNILEE

SEQ ID NO: 738 - protein, 331 aa, Sorghum bicolor
MSMAASTAAAVAVPEVSLRSGDARPMPMVGMGTAQFPVVNEATRNAVLAAIEVGFRHFDTAFLYGTEEPLGEAAAEAIRRGLVRSREDLFVTSKLWCTQNHPHLVLPSLRETLKNLQMEYVDLYLIHWPVCIKPGPPKFPNKKEDAVPVDFEGVWRAMEECQRLGLARAIGVSNFTTKHLDRVLAVATIPPAVNQVELNPAWQQRTLRAYCADRGIHVAAYSPLGGQNWDGQGNAVLDSEVLAEIAKARGKTVAQVALRWIHEQGVTSIAKSYNKERLKQNLEIFDWELTEEDRLKISQIPQRKVVQATSLFSEEGEFTSVDPEEMNIAEE

SEQ ID NO: 739 - protein, 328 aa, Pennisetum glaucum
MASTATTAAVPEVALQSGDARPMPAVGMGTASFPLVPEATKNAVLAAIEVGYRHFDTAYLYGTEKPLGEVVAEAVRRGLVASREELFITSKLWCTQNHPDLVLPSLRETLKNLQMEYLDLYLIHWPVAMKPKPPTFPSKKEDAVPFDIEGVWRAMEECQRLGLAKAIGVSNFTTKHLDRVLAASTIPPAVNQVELNPAWQQRTLRTYCAEKGIHIAAYSPLGGQNWDGTGNAVLESEVLAGIAKARGKTVAQVALRWIYEQGVTSIVKSYNKERLKQNLEIFDWELTDEDRLKISQIPQKKVVKHSGLFSQEGEFTSVNPADLNIVEE

SEQ ID NO: 740 - protein, 843 aa, Sorghum bicolor
MMMAQQPQTTQLLLHGVIDARILEADLSVTTDGKLQPTKKTLMKKKVFSWIRKLTFCKGQLENAIGLGTDGKLYATVDIDKARVGRTRMVPPVHSPKWDESFHIYCAHDASNIIFTVKADNAIGATLIGRAYLPTEGVVAGQKVDLWLPIRDEKRQPLEGGDQIRVQLQFTNVAADPTAGWGTGVGSGAYGGVPYTFFKQRRGCRVRLYEDAHVAGDFAPRVRLADGSFYEPRRCWVDVFDAINRARRMVYVAGWSVNTDVVLVRDPREPSSASSENLGELLIRKANEGVAVLMLVWDDRTSVGLGPIKRDGLMATHDQDTESFFRDTRVQCVLCPRNPDKDRSYVQDIETATMFTHHQKTVIVDGGGGRTGPESPPGLVSFLGGIDLCDGRYDTQDHPLFRTLGTTHSRDFHQPNFPGASISKGGPREPWHDIHCRVEGPAAWDVLENFEQRWKKQGKGDNMLVALNKAWAEREAAAGDAESWNVQVFRSIDGGAAAGFPEGSADAPREAAALGLVSGKDHVIERSIQDAYIHAIRRARDFVYIENQYFLGSSYAWRRQNDGVTVEDINALHLIPKELSLKIVSKIEAGERFAVYVVVPLWPEGVPESGSVQAILDWQRRTMEMMYRDVTLAIRAKGLQDDPRDYLTFFCLGNREAPSPGEYVPPDHPDPNTDYERAQQARRFMIYVHAKTMIVDDEYIIVGSANINQRSMDGGRDTEIAMGAYQPGYLATRNRPARGQVHGFRVSLWQEHLAQAAAAAAGGDLLRPSSLACVRRMNQVAKQHWDMFASDAFRGDLPGHLMAYPVSVLDDGSVVATTESFPDTNNAKVLGNKSDILPPILTT

SEQ ID NO: 741 - protein, 831 aa, Setaria italica
MAQLLLHGLIDARIVAADLSVTSDGQLQPTKKTRMKRKVFSWISKLPFCKCQRLENAIGLGTAGKLYATVDIDKARVGRTRMLDPVHSPRWNEAFRIYCAHDASNIIFTVKADNAIGATLIGRAYLPTRDVVAGQKVERWLDICDEKRQPLEGGDKIHVQLQFTDVAADPEGGWGAGVGGAGPYGGVPRTFFEQRRGCRVRLYGDAHVFDGFAPHVQLDGGRPYEPRRCWEDVFEAINNARRMVYIAGWSVNTGVQLVRDPRRPSSETLGQLLIRKADEGVTVLMLVWDDRTSGGLGPIKRDGLMATHDEDTAGFFRGTRVHCVLCPRNPDKDRSYVQDVETATMFTHHQKTVVVDGGGVPGPNAPPGLVSFLGGIDLCDGRYDTQEHPLFHTLGTTHNKDFHQPNFPGASIKKGGPREPWHDVHCRVEGPAAWDVLDNFEQRWRKQGSGDNLLVALDKAWAPREAAAGDAESWNVQVFRSIDGGAAAGFPENRDEAPDEAARRGLVSGKDHVIERSIQDAYIHAIRRARDFIYIENQYFLGSSYAWRQNDGVTVEAINALHLIPKELSLKIVSKIEAGERFAVYVVLPMWPEGVPESGSVQAILDWQRRTMEMMYRDVSLAIRAKGLQADPRDYLTFFCLGNREAPRPGEYVPPERPDPDTDYERAQQARRFMIYVHAKTMIVDDEYIIVGSANINQRSMDGGRDTEIAMGAYQPSHLATRNRPARGEVHGFRVALWQEHLGQAAAAAAGELLLRPSSLACVHRVNQVAQQHWDMFASDTFQGDLPGHLMAYPIVVGDEGKITGMTTQFPDTKAKVLGSKSNVLPPILTT

SEQ ID NO: 742 - protein, 843 aa, Zea mays
MKKMFSWIRKVAFCRCQVSPHPRSFELVYYTPAILAVAHVHEPYAFWAQRQLENAVGLGTDGKLYATVDIDKARVGRTRMVPPVNSPKWDESFRIYCAHDASDIIFTVKADNAIGATLIGRAYLPTDSVVAGNKVNLWLPIRDEKRQPLEGGDQIHVQLQFTDVAADPTAGWGAGVGSAAYDGVPHTFFKQRRGCRVRLYEDAHVAADFSPRIRLAGGRFYEPRRCWVDVFDAINRARRMVYIAGWSVNTDVVLVRDPRKQAAAASENLGELLIRKANEGVTVLMLVWDDRTSVGLGPIRRDGLMATGDQDTAAFFRGTRVQCVLCPRNPDKDRSYVQDIETDTMFTHHQKTVIVDGGGRPAPWSPPGLVGFLGGIDMCDGRYDTQDHPLFRTLGTTHNRDFHQPNFPGASISKGGPREPWHDIHCRVEGPAAWDVLENFEQRWRKQGKGDNLLVALNKEWAEREAAPRGDAESWNVQVFRSIDGGAAAGFPEPSADAPREAAALGLVTGKDHVMERSIQDAYIHAIRRARDFVYIENQYFLGSSYAWRQNDGVSVEDINALHLIPRELSLKIVSKIEAGERFAVYVVVPLWPEGVPESGSVQAILDWQRRTMEMMYKDVLMAIRAKGLQADPRDYLTFFCLGNREAPCPGEYVPPEHPDPNTDYERAQRARRFMIYVHAKTMIVDDEYIIVGSANINQRSMDGGRDTEIAIGAYQPGYLAIRNTWGRRRRRHWAARGQVHGFRVSLWKEHLGQAAAAALGGDLLRPSSLTCVRRMNQVAKQHWDMFASDAFQGNLPGHLMAYPVSVLDDGGGKIVATTETFPDTNAKVLGIKSDILPPILTT

SEQ ID NO: 743 - protein, 338 aa, Zea mays
MRSTWLAFALSALVVVSSSAAHVHASPGKLEVGFYEHSCAQAEDIVRNAVRRGIAREPGVGAGLIRMHFHDCFVRGCDGSILINSTPGNLAEKDSVANNPSMRGFDVIDDAKAVLEAHCPRTVSCADIVAFAARDSTYLAGGLDYKVPSGRRDGRVSKEEEVLDNNVPAPTDEVDELIESFKRKGLNADDMVTLSGAHTIGRSHCSSFTQRLYNFSGQLGQTDPSLDPAYAGHLKARCPWPSSDDQMDPTVVPLDPVTPATFDNQYYKNVLAHKVLFISDNTLLDNPWTAGMVHFNAAVEKAWQVKFAKAMVKMGKVQVLTGDEGEIREKCFAVNPHY

SEQ ID NO: 744 - protein, 338 aa, Zea mays
MRSTWLAFALSALVVVSSSAAHAHASPGKLEVGFYEHSCAQAEDIVRNAVRRGIAREPGVGAGLIRMHFHDCFVRGCDGSILINSTPGNLAEKDSVANNPSMRGFDVIDDAKAVLEAHCPRTVSCADIVAFAARDSTYLAGGLDYKVPSGRRDGRVSKEEEVLDNNVPAPTDEVDELIESFKRKGLNADDMVTLSGAHTIGRSHCSSFTQRLYNFSGQLGQTDPSLDPAYAGHLKARCPWPSSDDQMDPTVVPLDPVTPATFDNQYYKNVLAHKVLFISDNTLLDNPWTAGMVHFNAAVEKAWQVKFAKAMVKMGKVQVLTGDEGEIREKCFAVNPHY

SEQ ID NO: 745 - protein, 340 aa, Sorghum bicolor
MRLTWLAIAFALAALVVVSSSAARAQASPAELEVGFYKHSCPKAESIVRNAVRRGIARDAGVGAGLIRMHFHDCFVRGCDASILINSTPRNKAEKDSVANNPSMRGFDVVDDAKAVLEAHCPRTVSCADIIAFAARDGAYLAGGLDYKVPSGRRDGRVSKEDEVLDNNVPAPFDDVAELIKSFKRKGLNADDMVTLSGAHTIGRSHCSSFTQRLYNFSGQLGRTDPSLDPTYAEHLKMRCPWPSSNGQMDPTVVPLDPVTPATFDNQYYKNVLAHKGLFVSDNTLLDNPWTAGMVHFNAAVEKAWQVKFAKAMVKMGKVQVLTGDEGEIREKCFVVNPHY

SEQ ID NO: 746 - protein, 333 aa, Sorghum bicolor
MVSTWLATVLAALVVATAAHAAAELEVGFYKHSCPKAEEIVRNAVRRGIARDAGVGAGLIRMQFHDCFVRGCDASILINSTPGNKAEKDSVANNPSMRGFDVVDDAKAVLEAHCPRTVSCADIIAFAARDGAYLAGGLDYKVPSGRRDGRVSKEDEVLDNNVPAPFDDVAELIKSFKRKGLNADDMVTLSGAHTIGRSHCSSFTQRLYNFSGQLGRTDPSLDPTYAEHLKMRCPWPSSNGQMDTTVVPLDPVTPATFDNQYYKNVLAHKVLFVSDNTLLDNPWTAGMVHFNAAVEKAWQVKFAKAMVKMGKVQVLTGDEGEIREKCFVVNPHY

SEQ ID NO: 747 - protein, 339 aa, Zea mays
MSSTWLAFAWAAAALVVAASTAHAPHHPSSLQVGFYKHSCPQAEDIVRNAVRRGLVRDPGVGAGLIRMHFHDCFVRGCDASILINSTPGNLAEKDSVANNPSMRGFDVIDDAKAALEAHCPRTVSCADIVAFAARDSACSAGGLEYEVPSGRRDGRVSRQDEVLDNNVPTPTDVVAELIESFKRKGLSADDMVTLSGAHTIGRSHCSSFTQRLYNFSGQLGWTDPSLDPAYAGHLKARCPWPSSDDQMDPTVVPQDPVTPATFDNQYFKNVLAHKVLFVSDNTLLDNPWTAGIVQFNAAVEKAWQVRFAKAMVKMGKVQVLTGDEGEIREKCFVVNPHY

SEQ ID NO: 748 - protein, 338 aa, Saccharum officinarum
MRSTWLAFAWAAALVVAASTTAHASHHASLEVGFYKQSCPQAEEIVRNAVRRGVARDPGVGAGLIRMHFHDCFVRGCDGSILINSTPGNKAEKDSVANNPSMRGFDVVDDAKAVLEAHCPRTVSCADIVAFAARDGAYLDGGIDYKVPSGRRDGHVSREEEVLDDNVPTPTDDVAELIASFERKGLSGEDMGTLSGAHTIGRSHCSSFTQRLYNFSGQLGRTDPSLDPAYAEHLKMRCPWPSSDEQMDPTVVPQDPVTPATFDNQYFKNVLAHKGLFISDKTLLDNPWTAGIVHFNAAVEKAWQVKFAKAMVKMGKVQVLTGDEGEIREKCFVVNPHY

SEQ ID NO: 749 - protein, 333 aa, Setaria italica
MRSTWLPFAMAALVLASVSAHASHLEVGFYKHSCPEAEEIVRNAVRRGLARDPGVGAGLIRMHFHDCFVRGCDGSILINSTPGNRAEKDSVANNPSMRGFDVIDDAKAVLEAHCPRTVSCADVVAFAARDGAYLAGGIEYQVPSGRRDGRVSIEAEVLNNNVPAPTDRLRELIESFKRKGLSADDMVTLSGAHTIGRSHCSSFTQRLYNFSGQLGKTDPSIDPAYAEHLKMRCPWPSSDDQMDPTVVPLDPVTPASFDNQYFKNVLAHKVVLTSDQTLLDSPWTAGIVKFNSAVEKAWQLKFAASMIKMGKIEVLTGDEGEIREKCFVVNPHY

SEQ ID NO: 750 - protein, 336 aa, Setaria italica
MTRSTWLPFAMAALVVASVAHASPPAKLKVGFYKHSCPEAEEIVRNAVRRGLARDPGVGAGLIRMHFHDCFVRGCDSSILINSTPGNRAEKDSVANNPSMRGFDVIDDAKAVLEAHCPRTVSCADVVAFAARDGAYLAGGIEYQVPSGRRDGRVSIEAEVLNNNVPAPTDRLRELIESFKRKGLSADDMVTLSGAHTIGRSHCSSFTQRLYNFSGQLGKTDPSIDPAYAEHLKKRCPWPSSDDQMDPTVVPLDPVTPASFDNQYFKNVLSHKVVLTSDQTLLDSPWTAGIVKFNSAVEKAWQLKFAASMIKMGKIEVLTGDEGEIREKCFVVNPHY

SEQ ID NO: 751 - protein, 343 aa, Sorghum bicolor
MSRSTWLAFAWAAALVVVVVAASTTTTAHASHHASLEVGFYKHSCPEAESIVRDAVRRGVARDAGVGAGLIRMQFHDCFVRGCDASILINSTPGNKAEKDSVANNPSMRGFDVVDDAKAVLEAHCPRTVSCADIVAFAARDGAYLAGGLDYKVPSGRRDGRVSREDEVLDSNVPAPFDDVAELIQSFKRKGLTADDMVTLSGAHTIGRSHCSSFTQRLYNFSGQLGRTDPSLDVAYADHLKMRCPWPSSDGKRHPAVVPQDPVTPATFDNQYFKNVVAHKGLFVSDKTLLDSTCTAGIVHFNAAVDKAWQVKFAKAMVKMGKIQVLTGDEGEIREKCFVVNPH

SEQ ID NO: 752 - protein, 334 aa, Echinochloa colona
MKPTWLAFAMAALVVVATAAHASHLEVGFYKHSCPQAEEIVRNAVRRAIAREPGLGAGLIRMHFHDCFVRGCDGSILINSIPGQPMAEKDSVANNPSMRGFDVIDDAKAALEAHCPRTVSCADVVAFAARDGAYLAGGIDYQVPSGRRDGRVSLSSEVLNNNVPGPTFHVDKLVESFKRKGLSADDMVTLSGAHTIGRSHCSSFTQRLYNFSGQLGKTDPSIDAAYAEHLKARCPWPSSNGQMDPTVVPLDPVTPASFDNQYFKNVLAHEVVLTSDQTLLKNRWTAGIVKFHAAVEKAWEIKFAAAMIKMGKIEVLTGNEGEIREKCFVVNPHY

SEQ ID NO: 753 - protein, 334 aa, Echinochloa colona
MKPTWLAFAMAALVVVATAAHASHLEVGFYKHSCPQAEEIVRNAVRRAIAREPGLGAGLIRMHFHDCFVRGCDGSILINSIPGQPAAEKDSVANNPSMRGFGVIDDAKAALEAHCPRTVSCADVVAFAARDGAYLAGGIDYQVPSGRRDGRVSLSSEVLNNNVPGPTFHVDKLVESFKRKGLSADDMVTLSGAHTIGRSHCSSFTQRLYNFSGQLGKTDPSIDAAYAEHLKARCPWPSSNGQMDPTVVPLDPVTPASFDNQYFKNVLAHKVVLTSDQTLLKNRWTAGIVKFHAAVEKAWEIKFAASMIKMGQIEVLTGNEGEIREKCFVVNPHY

SEQ ID NO: 754 - protein, 336 aa, Panicum virgatum
MRSTWLAFAVAALLVASVAHASPWPPGKLKVGFYKDSCPQAEDIVRNAVRRALESEPGVGAGIIRMHFHDCFVRGCDASILINSTPGNKAEKDSVANNPSMRGFEVIDDAKAVLEAHCPRTVSCADIIAFAARDGADLAGGIKYQVPSGRRDGRVSIEAEVLNNNVPGPTDHVGELVESFRRKGLSADDMVTLSGAHTIGRSHCSSFTQRLYNFSGQLGRTDPSIDPAYAEHLKQRCPWPSSDAQMDPTVVPLDPVTPAKFENQYFKNVLAHKVVLTSDQTLLDSPRTAGIVRFHAAVDKAWQVKFAASMIKMGNIEVLTGDQGEIREKCFVVNHY

SEQ ID NO: 755 - protein, 1020 aa, Sorghum bicolor
MESYLKENFGAVQAKHSSEEALGRWRKLVGVVKNPKRRFRFTANLDKRSEATAMKKNNHEKLRVAVLVSKAALQFINSIAPSSEYKVPADVKAAGFGICAEELSSIVEGHDVKKLKSHGGVQGLASKLSTSESDGLATSADKLSTRRGVFGVNKFAEAESRGFLVFVWEALQDMTLMILAVCAFVSLMVGIATEGWPKGAHDGLGIVASILLVVFVTASSDYRQSLQFKDLDKEKKKITVQVTRSGYRQKLSIYELLAGDIVHLSIGDQVPADGLFMSGFSLLINESSLTGESEPVAVNAENPFLLSGTKVQDGSCKMLVTTVGMRTQWGKLMATLSEGGDDETPLQVKLNGVATIIGKIGLIFAVVTFAVLTESLFRRKIMDGTYLSWTGDDALELLEFFAIAVTIVVVAVPEGLPLAVTLSLAFAMKKMMNDKALVRHLAACETMGSATSICSDKTGTLTTNHMTVVKACICGKIKEVDGDSDTKSLFSELPDSVMTILSQSIFNNTGGDVVLNQDGKREILGTPTETAILEFGLSLGGDFSAVRKASTLVKVEPFNSAKKRMGVVIQLPEGALRAHCKGASEIILASCSKYLNEEGNVVPLDEGTIDHLKATIDSFANEALRTLCLAYMEVEDGFSANDQIPTDGYTCIGIVGIKDPVRPGVKESVAICRSAGITVRMVTGDNINTAKAIARECGILTEGGIAIEGPDFRTKSEEELTQLIPKIQVMARSSPLDKHTLVKHLRTKLDEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNNELMKRTPVGRKGNFISNIMWRNILGQAFYQFLVIWYLQTEGKWLFGIKGDNSDLVLNTLIFNCFVFCQVFNEMSSREMERINVFEGILNNNVFIAVLGSTVIFQFIIIQFLGDFANTTPLTLNQWIACICIGFIGMPIAAIVKMIPVGSS

SEQ ID NO: 756 - protein, 1020 aa, Setaria italica
MESYLKENFGGVQAKHSSEEALGRWRKVVGVVKNPKRRFRFTANLDKRSEVTAMKRKNHEKLRVAVLVSKAALQFVHSITPSGEYKVPADVKEAGFGICAEELSSIVEGHDLKKLKSHGGVESLASKLSTSESDGLATSADKLAKRQDLFGVNKFAEAESRGFWVFVWEALQDMTLMILAACAFFSLIVGIATEGWPKGAHDGLGIVASILLVVFVTASSDYRQSLQFKDLDKEKKKITVQVTRSGYRQKLSIYDLLAGDIVHLSIGDQVPADGLFLSGFSLLINESSLTGESEPVAVNAENPFLLSGTKVQDGSCKMLVTTVGMRTQWGKLMATLSEGGDDETPLQVKLNGVATIIGKIGLIFAVVTFAVLTESLFRRKINDGTYLSWTGDDALELLEFFAIAVTIVVVAVPEGLPLAVTLSLAFAMKKMMNDKALVRHLAACETMGSATSICSDKTGTLTTNHMTVVKACICGKIKEVDGASDTKSLFSELPDSVMTMLSQSIFNNTGGDVVFNQDGKREILGTPTETAILEFGLSLGGDFSAVRKASTLVKVEPFNSAKKRMGVVIQLPEGALRAHCKGASEIILASCNKYLNEEGNVVPLDKATIDHLNATIDSFANEALRTLCLAYIEVQEGFSANDQIPADGYTCIGIVGIKDPVRPGVKESVAICRSAGITVRMVTGDNINTAKAIARECGILTEGGIAIEGPDFRTKSEEELTQLIPKIQVMARSSPLDKHTLVKHLRTKLEEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNNELMKRTPVGRKGNFISNIMWRNILGQSLYQFLVIWYLQTEGKWLFGINGDNSDLVLNTLIFNCFVFCQVFNEVSSREMEKINVFEGILNNNVFVAVLSSTVIFQFIIIQFLGDFANTTPLTFNQWIACIFIGFIGMPIAAIVKMIPVGSS

SEQ ID NO: 757 - protein, 1020 aa, Panicum virgatum
MESYLKENFGGVQAKHSSEEALGRWRKVVGVVKNPKRRFRFTANLDKRSEVTAMKRKNHEKLRVAVLVSKAALQFIHGLAPSSEYKVPADVKAAGFGICAEELSSIVEGHDLKKLKSHGGVESLTSKLSTSESDGLTTSADKLATRQQLFGVNKFAEAESRGFWVFVWEALQDMTLMILAACAFVSLIVGIATEGWPKGAHDGLGIVASILLVVFVTASSDYRQSLQFKDLDKEKKKITVQVTRSGYRQKLSIYDLLAGDIVHLSIGDQVPADGLFLSGFSLLINESSLTGESEPVAVNAENPFLLSGTKVQDGSCKMLVTTVGMRTQWGKLMATLSEGGDDETPLQVKLNGVATIIGKIGLIFAVITFAVLTESLFRRKISDGTYLSWTGDDALELLEFFAIAVTIVVVAVPEGLPLAVTLSLAFAMKKMMNDKALVRHLAACETMGSATSICSDKTGTLTTNHMTVVKACICGKIKEVDGASDTKSLFSELPDSVMMMLAQSIFNNTGGDVVINQDGKREILGTPTETAILEFGLSLGGDFSPVRQASTLVKVEPFNSAKKRMGVVIQLPGGALRAHCKGASEIILASCNKYLNEEGNVVPLDKATIDHLNATIDSFANEALRTLCLAYMEVQDGFSANDQIPADGYTCIGIVGIKDPVRPGVKESVAICRSAGITVRMVTGDNINTAKAIARECGILTEGGIAIEGPDFRTKSEEEMTQLIPKIQVMARSSPLDKHNLVKHLRNNLDEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNNDLMKRTPVGRKGNFISNIMWRNILGQAFYQFLVIWYLQTEGKWLFGIKGDNSDLVLNTLIFNCFVFCQVFNEVSSREMEKINVFEGILNNNVFIAVLGSTVIFQFIIIQFLGDFANTAPLTLNQWIACIFIGFIGMPIAAIVKMIPVGSS

SEQ ID NO: 758 - protein, 1020 aa, Panicum virgatum
MESYLKENFGGVQAKHSSDEALGRWRKVVGVVKNPKRRFRFTANLDKRSEVTAMKRKNHEKLRVVVLVSKAALQFIHGLAPSSEYKVPDDVKAAGFGICAEELSSIVEGHDLKKLKSHGGIESLASKLSTSESDGLTTSADKLETRRQLFGVNKFAEAESRGFWVFVWEALQDMTLMILAACAFVSLIVGIATEGWPKGAHDGLGIVASILLVVFVTASSDYRQSLQFKDLDKEKKKITVQVTRSGYRQKLSIYDLLAGDIVHLSIGDQVPADGLFLSGFSLLINESSLTGESEPVAVNAENPFLLSGTKVQDGSCKMLVTTVGMRTQWGKLMATLSEGGDDETPLQVKLNGVATIIGKIGLIFAVITFAVLTESLFRRKISDGTYLSWTGDDALELLEFFAIAVTIVVVAVPEGLPLAVTLSLAFAMKKMMNDKALVRHLAACETMGSATSICSDKTGTLTTNHMTVVKACICSKIKDVDGASDTKSLFSELPDSVMMMLSQSIFNNTGGDVVINQDGKREILGTPTETAILEFGLSLGGDFSAVRQASTLVKVEPFNSAKKRMGVVIQLPGGALRAHCKGASEIILASCNKYLNEEGNVVPLDKATIDHLNATIDSFANEALRTLCLAYMEVQDGFSANDQIPADGYTCIGIVGIKDPVRPGVKESVAICRSAGITVRMVTGDNINTAKAIARECGILTEGGIAIEGPDFRTKSEEEMTQLIPKIQVMARSSPLDKHTLVKHLRNNLDEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNNDLMKRTPVGRKGNFISNIMWRNILGQAFYQFLVIWYLQTEGKWLFGIKGDNSDLVLNTLIFNCFVFCQVFNEVSSREMEKINVFEGILNNNVFIVVLSSTIIFQFIIIQFLGDFANTTPLTFNQWITCIFIGFIGMPIAAIVKMIPVGSS

SEQ ID NO: 759 - protein, 1020 aa, Echinochloa colona
MESYLKENFGGVQAKHSSEEALGRWRKVVGVVKNPKRRFRFTANLDKRSEVNAMKKKNNEKLRVAVLVSKAALQFIHALPPPSEYKVPADVKAAGYGICAEELSSIVEGHDLKKLKSHGGVESLASKLSTSESDGLATSEDKLATRRKLFGVNKFAEAASRGFWVFVWEALQDMTLMILAVCAFVSLIVGVATEGWPKGAHDGLGIVASILLVVFVTASSDYRQSLQFKDLDKEKKKITVQVTRSGYRQKLSIYDLLAGDIVHLSIGDQVPADGLFLSGFSLLINESSLTGESEPVAVNAENPFLLSGTKVQDGSCKMLVTTVGMRTQWGKLMATLSEGGDDETPLQVKLNGVATIIGKIGLIFAVVTFAVLTESLFRRKINDGTYLSWTGDDALELLEFFAIAVTIVVVAVPEGLPLAVTLSLAFAMKKMMNDKALVRHLAACETMGSATSICSDKTGTLTTNHMTVVKACICGKIKEVDGATDTKSLFSELPDSVMMMLSQSIFNNTGGDVVFNQDGKREILGTPTETAILEFGLSLGGDFSAVRKASTLVKVEPFNSAKKRMGVVIQLPGGALRAHCKGASEIILASCDKYLNEEGNVVPLDKATIDHLNATIDSFANEALRTLCLAYMEVQDGFSANDQIPADGYTCIGIVGIKDPVRPGVKESVAICRSAGITVRMVTGDNINTAKAIARECGILTEGGIAIEGPDFRTKSEEELTQLIPKIQVMARSSPLDKHTLVKHLRTKLDEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNNELMKRTPVGRKGNFISNIMWRNILGQAFYQFLVIWYLQTEGKWLFGIKGDNADLVLNTLIFNCFVFCQVFNEVSSREMEKINVFEGILNNNVFIAVLSSTVVFQFIIIQFLGDFANTTPLTVNQWIACICIGFIGMPIAAIVKMIPVGSS

SEQ ID NO: 760 - protein, 1020 aa, Pennisetum glaucum
MESYLKENFGGVQPKHSSEEALGRWRKVVGVVKNPKRRFRFTANLDKRSEVTAMKRKNHEKLRVAVLVSKAALQFVSSLAPSGEYKVPADVKAAGFGICAEELSSIVEGHDLKKLKSHGGIESLASKLSTSESDGLDTSSDKLAKRQELFGVNKFAEAESRGFWVFVWEALQDMTLMILAACAFFSLIVGIATEGWPKGAHDGLGIVASILLVVFVTASSDYRQSLQFKDLDKEKKKITVQVTRSGYRQKLSIYELLAGDIVHLSIGDQVPADGLFLSGFSLLINESSLTGESEPVAVNAENPFLLSGTKVQDGSCKMLITTVGMRTQWGKLMATLSEGGDDETPLQVKLNGVATIIGKIGLIFAVVTFAVLTESLFRRKINDGTYLSWTGDDALELLEFFAIAVTIVVVAVPEGLPLAVTLSLAFAMKKMMNDKALVRHLAACETMGSATSICSDKTGTLTTNHMTVVKACICGKIKEVDGASDAKSLFSELPDSVMTMLSQSIFNNTGGDVVVNQDGKREIMGTPTETAILEFGLSLGGDFSAVRKASTLVKVEPFNSAKKRMGVVIQLPGGALRAHCKGASEIILASCDKYLNEEGNVVPLDKATIDHLNATIDSFANEALRTLCLAYMEVQDGFSANDQIPADGYTCIGIVGIKDPVRPGVKESVAICRSAGITVRMVTGDNINTAKAIARECGILTEGGIAIEGPDFRTKSEEELTQLIPKIQVMARSSPLDKHTLVKHLRTKLDEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNDELMKRTPVGRKGNFISNIMWRNILGQSFYQFLVIWYLQTEGKWLFGINGANSDLVLNTLIFNCFVFCQVFNEVSSREMEKINVFQGILNNNVFVAVLSSTVIFQFIIIQFLGDFANTIPLTFKQWIACISIGFIGMPIAAIVKMIPVGSS

SEQ ID NO: 761 - protein, 1020 aa, Brachypodium distachyon
MESYLNENFGGVKAKHSSDEALGRWRKVVGVVKNPKRRFRFTANLGKRSEAAAMKRTNQEKLRVAVLVSKAALQFIHGLAPQSEYTVPADVKAAGYGICAEELSSVVESHDLKKLKAHGGTEALISKISTSESDGLSTAKGKLASRQEIFGINKFAETEARSFWVFVWEALQDMTLMILAACAFFSLVVGIATEGWPKGAHDGLGIVASILLVVFVTATSDYRQSLQFKDLDKEKKKITVQVTRSGYRQKLSIYDLLVGDIVHLSIGDQVPADGLFVSGFSLLINESSLTGESEPVAVNAENPFLLSGTKVQDGSCKMLVTTVGMRTQWGKLMATLSEGGDDETPLQVKLNGVATIIGKIGLVFAVVTFAVLTESLFRRKIMDGSYLSWTGDDALELLEFFAIAVTIVVVAVPEGLPLAVTLSLAFAMKKMMNDKALVRHLAACETMGSATSICSDKTGTLTTNHMTVVKACICGKIKEVDNSSETKSLFSELPDSAMTMLSQSIFNNTGGDVVINQDGKREILGTPTETAILELGLSLGGDFQAVRKASTLVKVEPFNSAKKRMGVVIQLPGGAFRAHCKGASEIILASCSKYINDQGNVVPLDSATVAHLNATIDSFANEALRTLCLAYIEVEGDFSANDPIPEDGYTCIGIVGIKDPVRPGVKESVAICRSAGITVRMVTGDNINTAKAIARECGILTEGGLAIEGPDFRIKSAEELNDIVPKIQVMARSSPLDKHTLVKHLRTKLGEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNNELMKRTPVGRKGNFISNIMWRNIMGQAFYQFLVIWYLQTEGKWLFGIKGDNSDLVLNTLIFNCFVFCQVFNEVSSREMERINVFKGILNNNVFVAVLGSTVIFQIIIVQFLGDFANTTPLSFKQWFTCIVIGFIGMPIAAIVKLIPVGSS

SEQ ID NO: 762 - protein, 1020 aa, Triticum aestivum
MESYLNENFGGVKPKHSSDEALGRWRKVVGVVKNPKRRFRFTANLGKRSEAAAMKRTNQEKLRVAVLVSKAALQFIHGLAPHSEYTVPAAVKAAGYGICAEELSSVVESHDIKKLKAHGGTEGLISKVSTSESDGVSTSKDKLASRQEIFGINKFAETEARSFWVFVWEALHDMTLMILAACAFFSLVVGIATEGWPKGAHDGLGIVASILLVVFVTATSDYRQSLQFKDLDKEKKKITVQVTRSGYRQKLSIYELLVGDIVHLSIGDQVPADGLFVSGFSLLINESSLTGESEPVAVNAENPFLLSGTKVQDGSCKMLVTTVGMRTQWGKLMATLSEGGDDETPLQVKLNGVATIIGKIGLVFAVVTFAVLTESLFRRKIMDGSYLSWSGDDALELLEFFAIAVTIVVVAVPEGLPLAVTLSLAFAMKKMMNDKALVRHLAACETMGSATSICSDKTGTLTTNHMTVVKACICGKIKEVEKSSDTKSLFSELPASVMTMLSQSIFNNTGGDVVINQDGKREILGTPTEAAILELGLSLGGDFQAVRKATTLIKVEPFNSAKKRMGVVIQLPGGAFRAHCKGASEIILASCSKYLNDQGNAVPLDTATIAHLNATIESFANEALRTLCLAYIEVADGFSANDAIPEEGYTCIGIVGIKDPVRPGVKESVAICRSAGITVRMVTGDNINTAKAIARECGILTEGGLAIEGPDFRTKSAEEMYKLIPKIQVMARSSPLDKHTLVKNLRTTHEEVVAVTGDGTNDAPALHEADIGLAMGIAGTEVAKESADVIILDDNFSTIVTVAKWGRSVYINIQKFVQFQLTVNVVALVVNFSSACMTGSAPLTAVQLLWVNMIMDTLGALALATEPPNDELMKRTPVGRKGNFISNIMWRNIMGQAIYQFFVIWYLQTEGKTLFELKGDNSDLVLNTLIFNCFVFCQVFNEVSSREMERINVFKGILNNNVFVAVLGSTVLFQIIIVQFLGDFANTTPLSLREWFSCIVIGFIGMPIAAIVKLFPVGSQ

SEQ ID NO: 763 - protein, 1021 aa, Avena sativa
MESYLNENFGGVKPKHSSDESLGRWRKVVGVVKNPKRRFRFTANLDKRSEAAAMKRTNQEKLRVAVLVSKAALQFIHGLAPQSDYTVPADVKAAGYGICAEELSAVVESHDIKKLKAHGGTEGLLSKVSTSESDGISTASQSKLASRQEIFGINKFAETESRSFWVFVWEALQDMTLMILAACAFFSLVVGIATEGWPKGAHDGLGIVASILLVVFVTATSDYRQSLQFKDLDKEKKKITVQVTRSGYRQKLSIYELLVGDIVHLSIGDQVPADGLFVSGFSLLINESSLTGESEPVAVNAENPFLLSGTKVQDGACKMLVTTVGMRTQWGKLMATLTEGGDDETPLQVKLNGVATIIGKIGLVFAVVTFAVLTESLFRRKIMDGSYLSWSGDDALELLEFFAIAVTIVVVAVPEGLPLAVTLSLAFAMKKMMNDKALVRHLAACETMGSATSICSDKTGTLTTNHMTVVKACICGKVKEVDNSSDTKSLFSELPESVMTMLLQSIFNNTGGDVVINQDGKREILGTPTESAILELGLSLGGDFQGVRKASTLIKVEPFNSAKKRMGVVIQLPGGGLRAHCKGASEIILASCSKYLNDQGLVVPLDTATVAHLNGTIDSFANEALRTLCLAYIEVGDGFSANDQIPEDGYTCIGIVGIKDPVRPGVKESVAICRSAGITVRMVTGDNINTAKAIARECGILTEGGLAIEGPDFRTRSAEELHKLIPKIQVMARSSPLDKHTLVKNLRTTFEEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNDELMKRTPVGRKGNFISNIMWRNIMGQALYQFIVIWYLQTEGKTLFGLKGDNSDLVLNTLIFNCFVFCQVFNEVSSREMERINVFKGILDNNVFVAVLGSTVIFQIIIVQFLGDFANTSPLSFKQWFYCIVIGFIGMPIAAIVKLFPVGSN

SEQ ID NO: 764 - protein, 1020 aa, Aegilops tauschii
MESYLNENFGGVKPKHSSDEALGRWRKVVGVVKNPKRRFRFTANLGKRSEAAAMKRTNQEKLRVAVLVSKAALQFIHGLAPQSEYTVPAAVKAAGYGICAEELSSVVESHDIKKLKAHGGTEGLLSKVSTSESDGVSTSKDKLASRQEIFGINKFAETEARSFWVFVWEALHDMTLMILAACAFFSLVVGIATEGWPKGAHDGLGIVASILLVVFVTATSDYRQSLQFKDLDKEKKKITVQVIRSGYRQKLSIYELLVGDIVHLSIGDQVPADGLFVSGFSLLINESSLTGESEPVAVNAENPFLLSGTKVQDGSCKMLVTTVGMRTQWGKLMATLSEGGDDETPLQVKLNGVATIIGKIGLVFAVVTFAVLTESLFRRKIMDGSYLSWSGDDALELLEFFAIAVTIVVVAVPEGLPLAVTLSLAFAMKKMMNDKALVRHLAACETMGSATSICSDKTGTLTTNHMTVVKACICGKIKEVEKSSDAKSLFSELPDSVMTMLSQSIFNNTGGDVVINQDGKREILGTPTEAAILELGLSLGGDFQAVRKATTLIKVEPFNSAKKRMGVVIQLPGGAFRAHCKGASEIILASCSKYLNDQGNAVPLDSATVAHLNATIESFANEALRTLCLAYIEVADGFSANDAIPEEGYTCIGIVGIKDPVRPGVKESVAICRSAGITVRMVTGDNINTAKAIARECGILTEGGLAIEGPDFRTKSAEEMYKLIPKIQVMARSSPLDKHTLVKNLRTTHEEVVAVTGDGTNDAPALHEADIGLAMGIAGTEVAKESADVIILDDNFSTIVTVAKWGRSVYINIQKFVQFQLTVNVVALVVNFSSACMTGSAPLTAVQLLWVNMIMDTLGALALATEPPNDELMKRTPVGRKGNFISNIMWRNIMGQAIYQFFVIWYLQTEGKTLFELKGDNSDLVLNTLIFNCFVFCQVFNEVSSREMERINVFRGILDNNVFVAVLGSTVLFQIIIVQFLGDFANTTPLSLREWFSCIVIGFIGMPIAAIVKLFPVGSQ

SEQ ID NO: 765 - protein, 1021 aa, Setaria italica
MESYLKENFGGVKAKHSSDEALGRWRSVVGVVKNPTRRFRFTANLDKRSEAAAMKRSNQEKLRVAVLVSKAALQFIHGLPPQADYAVPAAVAAAGFGVCAEELSSVVESHDVKRLKSHGGVEGVVSKLSTSASDGLPASARKLATRQELFGVNRFAEAEPRSFWVFVWEALQDMTLMILAACALVSLLVGVATEGWPHGAHDGLGIVASILLVVFVTATSDYRQSLQFKDLDKEKKKITVQVTRGGYRQKLSIYDLLVGDIVHLSIGDQVPADGLFVSGFSLLINESSLTGESEPVAVNAENPFLLSGTKVQDGSCKMLVTTVGMRTQWGKLMATLSEGGDDETPLQVKLNGVATIIGKIGLIFAVVTFAVLTQALFWRKVSDGSYFSWTGDDALELLEFFAIAVTIVVVAVPEGLPLAVTLSLAFAMKKMMNDKALVRHLAACETMGSATSICSDKTGTLTTNHMTVVKACICGKVKDVGSSSAETKTLTSDLPSSVVAMLLQSIFNNTGGDVVVNQDGKREILGTPTETAILEFGLSLGGDFSTVRKASTLIKVEPFNSAKKRMGVVIQLPGGALRAHCKGASEIILASCTKYMDEHGNVVELDGATVDHLKATIDSFANEALRTLCLAYIDVDEGFSANDQIPMDGYTCIGIVGIKDPVRPGVKESVAICRSAGITVRMVTGDNINTAKAIARECGILTEGGVAIEGPDFRVKSEEELQELIPKIQVMARSSPLDKHTLVKHLRTTFDEVVAVTGDGTNDAPALHEADIGLAMGIAGTEVAKESADVIILDDNFSTIVTVAKWGRSVYINIQKFVQFQLTVNVVALVVNFSSACLIGSAPLTAVQLLWVNMIMDTLGALALATEPPNNELMKRTPVGRKGNFISNIMWRNIMGQAIYQFLVIWYLQAEGKWLFGIKGDNSDLVLNTIIFNCFVFCQVFNEVSSREMERINVFEGILDNNVFAAVLGSTVVFQFIIIQFLGSFANTTPLTFTQWIASIFIGFIGMPIAAAVKMVPVDSV

SEQ ID NO: 766 - protein, 1019 aa, Oryza sativa
MESYLKENFGGVKAKHSSDEALGRWRRLVGVVKNPKRRFRFTANLDKRSEAAAMKRSNQEKLRVAVLVSKAALQFIQGLAPASEYTVPDDVKAAGYGICAEELSSIVESHDIKKLKSHGGVEAIAAKLCTSPEDGLPKSRRRQAVREELFGINRFAETESRSFWVFVWEALQDMTLMILAACAFFSLVVGIATEGWPKGAHDGLGIVASILLVVFVTATSDYRQSLQFKDLDKEKKKITVQVSRNGYRQKLSIYDLLAGDIVHLSIGDQVPADGLFLSGFSLLINESSLTGESEPVAVNAENPFLLSGTKVQDGSCKMLVTTVGMRTQWGKLMATLSEGGDDETPLQVKLNGVATIIGKIGLIFAVVTFAVLTEGLFRRKIMDASYLSWTGDDAMELLEFFAIAVTIVVVAVPEGLPLAVTLSLAFAMKKMMNDKALVRHLAACETMGSATTICSDKTGTLTTNHMTVVKACICGKIKDVESASDTKSLFSELPESAMTLLSQSIFNNTGGDVVFNKSGSREILGTPTETAILEFGLSLGGDFLAVRKASTLVKVEPFNSAKKRMGVVIQLPGGAMRAHSKGASEIILASCSKYLNDQGNVVPLDDATVAHLNATINSFANEALRTLCLAYVDVGDGFSANDQIPEDGYTCIGIVGIKDPVRPGVKESVAICRSAGIMVRMVTGDNINTAKAIARECGILTEGGIAIEGPDFRTKSAEELNELIPKIQVMARSSPLDKHTLVKHLRTTFDEVVAVTGDGTNDAPALHEADIGLAMGIAGTEVAKESADVIILDDNFSTIVTVAKWGRSVYINIQKFVQFQLTVNVVALIVNFSSACLTGSAPLTAVQLLWVNMIMDTLGALALATEPPNDELMKRTPVGRKGNFISNIMWRNILGQAFYQFIVIWYLQTEGKWLFGLKGENSDLVLNTLIFNCFVFCQVFNEVSSREMERINVFEGILDNNVFVAVLGSTVIFQFIIVQFLGDFANTTPLTLKQWFNCIFIGFIGMPIAAAVKLIPVDF

SEQ ID NO: 767 - protein, 1021 aa, Sorghum bicolor
MESYLNENFGGVKAKHSSDEALGRWRSVVGVVKNPTRRFRFTANLGKRSEAAAMKRSNQEKLRVAVLVSKAALQFIHGLPPQGDYAVPADVKAAGFGICAEELGSIVESHDVKKLKSHGGVDGLVSRLSTSASDGLADNDNKLMAARQEVFGVNRFAEAEQRSFWVFVWEALQDMTLMILAACALVSLLVGIATEGWPHGAHDGLGIVASILLVVFVTATSDYRQSLQFKDLDKEKKKITVQVTRSGYRQKLSIYDLLAGDIVHLSIGDQVPADGLFVSGFSLLINESSLTGESEPVAVSAENPFLLSGTKVQDGACKMLVTTVGMRTQWGKLMATLSEGGDDETPLQVKLNGVATIIGKIGLAFAVVTFAVLTQGLFWRKFADGSYFSWTGDDAMELLEFFAIAVTIVVVAVPEGLPLAVTLSLAFAMKKMMNDKALVRHLAACETMGSATTICSDKTGTLTTNHMTVVKACICGKIKDVSSSAETKTLPSDLPASVVAMLLQSIFNNTGGDVVLNQDGKREILGTPTEAAILEFGLSLGGDFSAVRKASTLLKVEPFNSAKKRMGVVIQLPGGELRAHCKGASEIILASCTKYLDEHGNVVSLDGATTDHLKATIDSFANEALRTLCLAYVDVGDGFSANDQIPMEGYTCIGVVGIKDPVRPGVKESVAICRSAGITVRMVTGDNINTAKAIARECGILTEGGVAIEGPDFRVKSEEELQQLIPKIQVMARSSPLDKHNLVKHLRTTFDEVVAVTGDGTNDAPALHEADIGLAMGIAGTEVAKESADVIILDDNFSTIVTVAKWGRSVYINIQKFVQFQLTVNVVALIVNFSSACLIGSAPLTAVQLLWVNMIMDTLGALALATEPPNDELMKRTPVGRKGNFISNIMWRNIMGQSFYQFLVIWYLQSQGKWLFGIEGANSDLLLNTIIFNCFVFCQVFNEVSSREMERINVFQGILDNNVFAMVLGSTVVFQFIIIQFLGSFANTTPLSFTQWMSCIAIGFIGMPIAVVVKMVPVDSV

SEQ ID NO: 768 - protein, 930 aa, Saccharum officinarum
SPSPAAPVQNSRLDTRVRCHDLKKLLSHGGVQGLASKLCTSESDGLTTSADKLATRRDVFGVNKFAEAESRGFLVFVWEALQDMTLMILAACAFVSLIVGIATEGWPKGAHDGLGIVASILLVVFVTASSDYRQSLQFKDLDKEKKKITVQVTRSGYRQKLSIYELLAGDIVHLSIGDQVPADGLFMSGFSLLINESSLTGEIEPVAVNAENPFLLSGTKVQDGSCKMLVTTVGMRTQWGKLMATLSEGGDDETPLQVKLNGVATIIGKIGLIFAVVTFAVLTESLFRRKITDGTYLSWTGDDALELLEFFAIAVTIVVVAVPEGLPLAVTLSLAFAMKKMMNDKALVRHLAACETMGSATSICSDKTGTLTTNHMTVVKACICGKIKEVDGASDAKSLSSELPDSVMTILSQSIFNNTGGDVVLNQDGKREILGTPTETAILEFGLSLGGDFSAVRKASTLVKVEPFNSAKKRMGVVIQLPEGALRAHCKGASEIILASCSKYLNEEGDVIPLDEGTIDHLKATIDSFANEALRTLCLAYMEVEDGFSVNDQIPTDGYTCIGIVGIKDPVRPGVKESVAICRSAGITVRMVTGDNINTAKAIARECGILTEGGIAIEGPDFRTKSEEELTQLIPKIQVMARSSPLDKHTLVKHLRTKLDEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNNELMKRTPVGRKGNFISNIMWRNILGQAFYQFLVIWYLQTEGKWLFGIKGDNSDLVLNTLIFNCFVFCQVFNEVSSREMERINVFEGILNNNVFIAVLGSTVIFQFIIIQLLGDFANTTPLTLNQWIACIFIGFIGMPIAAIVKMIPVGSS

SEQ ID NO: 769 - protein, 1034 aa, Zea mays
MDKMESYLNENFGGVKAKHSSDEALGRWRSVVGVVKNPTRRFRFTANLGKRSEAAAMKRSNQEKLRVAVLVSKAALQFIHGLPPQGDYAVPADVKAAGFGICAEELSFIVESHDVKKLKSHGGVDGLLSRLSTSASDGLDGSKLMAARQELFGVNRFAEAEPRSFWVFVWEALQDMTLMILAACALVSLVVGIATEGWPHGAHDGLGIVASILLVVFVTATSDYRQSLQFKDLDKEKKKITVQVTRSGYRQKLSIYDLLAGDIVHLAIGDQVPADGLFVSGFSLLINESSLTGESEPVAVSAENPFLLSGTKVQDGACKMLVTTVGMRTQWGKLMATLSEGGDDETPLQVKLNGVATIIGKIGLAFAVVTFAVLTQGLFWRKLADGSYFSWTGDDALELLEVFAIAVTIVVVAVPEGLPLAVTLSLAFAMKKMMNDKALVRHLAACETMGSATTICSDKTGTLTTNHMTVVKACICGKVKDVNSSAETKTLPSDLPASVVAMLLQSIFNNTGGDVVLNQDSRREILGTPTEAAILEFGLALGGDFATVRKASTLLKVEPFNSAKKRMGVVIQLPGGALRAHCKGASEIVLASCARYLDEHGNVAALDGATADHLRATIDSFANEALRTLCLAYVDVGDGFSPSDQIPTDGYTCIGVVGIKDPVRPGVKESVAICRSAGITVRMVTGDNINTAKAIARECGILTEGGVAIEGPDFRVKSEEELQDLIPKIQVMARSSPLDKHTLVKHLRTTFDEVVAVTGDGTNDAPALHEADIGLAMGIAGTEVHLIVSSNVCLKVAKESADVIILDDNFSTIVTVAKWGRSVYINIQKFVQFQLTVNVVALIVNFSSACLIGSAPLTAVQLLWVNMIMDTLGALALATEPPNDELMKRTPVGRKGNFISNTMWRNIMGQAIYQFLVIWYLQSRGKRLFWIDEGAADADLVLNTVIFNCFVFCQVFNEVNSREMERVNVFRGILDNNVFVMVLGSTVVFQFVIVQCLGSFANTTPLSLAQWVACVAIGFVGMPIAVAVKMVPVE

SEQ ID NO: 770 - protein, 1020 aa, Zea mays
MESYLNENFGGVKAKHSSEEALGRWRSVVGVVKNPTRRFRFTANLGKRSEAAAMKRSNQEKLRVAVLVSKAALQFIHGLPPQGDYAVPADVKAAGFGVCAEELGAIVETHDVKKLKSHGGVDGLVSRLSTSASDGLDDSNEPMTAARQELFGVNRFAEAEPRSFWVFVWEALQDMTLMILAACALVSLVVGIATEGWPHGAHDGLGIVASILLVVFVTATSDYRQSLQFKDLDKEKKKIAVQVTRRGYRQRLSIYDLLAGDIVHLSIGDQVPADGLFVSGFSMLIDESSLTGESEPVAVSAENPFLLSGTKVQDGACKMLVTTVGMRTQWGKLMATLSEGGDDETPLQVKLNGVATIIGKIGLAFAVVTFAVLTQSLFWRKLADGSWLSWTGDDALELLEFFAIAVTIVVVAVPEGLPLAVTLSLAFAMKKMMNDRALVRHLAACETMGSATTICSDKTGTLTTNHMTVVKACICGKVRDVNSSVETKTLPSDLPASVVAMLLQSAFNNTGGDIVLDQDGRREILGTPTEAAILEFGLSLGGDFAAVRKASTLLKVEPFNSARKRMGVVIQLPGGALRAHCKGASEIVLASCTRYLDERGSAVALDGATADRLRATIDSFANEALRTLCLAYVDVGDGFSPSEQIPTDGYTCICVVGIKDPVRPGVKESVAICRSAGITVRMVTGDNINTAKAIARECGILTDGGVAIEGPDFRVKTEEELQELIPKIQVMARSSPLDKHTLVKHLRTTFDEVVAVTGDGTNDAPALHEADIGLAMGIAGTEVAKESADVIILDDNFSTIVTVAKWGRSVYINIQKFVQFQLTVNVVALVVNFSSACLIGSAPLTAVQLLWVNMIMDTLGALALATEPPNDELMKRTPVGRKGNFISNVMWRNIMGQALYQFLVIWSLQSRGKSLFGIEGRADSDLVLNTIIFNCFVFCQVFNEVSSREMERVNVLRGILDNNVFAMVLGSTVVFQFVIVQCLGSFANTTPLSVAQWGACVAIGFVGMPVAVAVKMVPVE

SEQ ID NO: 771 - protein, 955 aa, Triticum aestivum
VLVSKAALQFIHGLAPQSEYTVPAAVKAAGYGICAEELSSVVESHDIKKLKAHGGTEGLLSKVSTSESDGVSTSKDKLASRQEIFGINKFAETEARSFWVFVWEALQDMTLMILAACAFFSLVVGIATEGWPKGAHDGLGIVASILLVVFVTATSDYRQSLQFKDLDKEKKKITVQVTRSGYRQKLSIYELLVGDIVHLSIGDQVPADGLFVSGFSLLINESSLTGESEPVAVNAENPFLLSGTKVQDGSCKMLVTTVGMRTQWGKLMATLSEGGDDETPLQVKLNGVATIIGKIGLVFAVVTFAVLTESLFRRKIMDGSYLSWSGDDALELLEFFAIAVTIVVVAVPEGLPLAVTLSLAFAMKKMMNDKALVRHLAACETMGSATSICSDKTGTLTTNHMTVVKACICGKIKEVDKSSNTKSLFSELPDSVMTMLSQSIFNNTGGDVVINQDGKREILGTPTETAILELGLSLGGDFQAVRKATTLLKVEPFNSAKKRMGVVIQLPGGAFRAHCKGASEIILASCSKYLNDQGNAVPLDSATIAHLNATIESFANEALRTLCLAYIEVAQGFSANDAIPEEGYTCIGIVGIKDPVRPGVKESVAICRSAGITVRMVTGDNINTAKAIARECGILTEGGLAIEGPDFRTKSAEEMFKLIPKIQVMARSSPLDKHTLVKNLRTTHEEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNDELMKRTPVGRKGNFISNIMWRNIMGQAIYQFFVIWYLQTEGKTLFELKGDNSDLVLNTLIFNCFVFCQVFNEVSSREMERINVFKGILDNNVFVAVLGSTVVFQIIIVQFLGDFANTTPLSLREWFSCIVIGFIGMPIAAIVKLFPVGSQ

SEQ ID NO: 772 - protein, 951 aa, Secale cereale
KAALQFIHGLAPQSEYTVPAAVKAAGYGICAEELSSVVESHDIKKLKAHGGTEGLLSKVSTSESDGLSTSQDKLASRQEIFGINKFAETEARSFWVFVWEALQDMTLMILAACAFFSLVVGIATEGWPKGAHDGLGIVASILLVVFVTATSDYRQSLQFKDLDKEKKKITVQVTRSGYRQKLSIYELLVGDIVHLSIGDQVPADGLFVSGFSLLINESSLTGESEPVAVNAENPFLLSGTKVQDGSCKMLVTTVGMRTQWGKLMATLSEGGDDETPLQVKLNGVATIIGKIGLVFAVVTFAVLTESLFRRKIMDGSYLSWSGDDALELLEFFAIAVTIVVVAVPEGLPLAVTLSLAFAMKKMMNDKALVRHLAACETMGSATSICSDKTGTLTTNHMTVVKACICGKIKEVDKSSDTKSLFSELPDSVMTMLSQSIFNNTGGDVVINQDGKREILGTPTETAILELGLSLGGDFQAVRKATTLLKVEPFNSAKKRMGVVIQLPGGAFRAHCKGASEIILASCNKYLNDQGNAVPLDSATIAHLNNTIESFANEALRTLCLAYIEVADGFSVNDAIPEEGYTCIGIVGIKDPVRPGVKESVAICRSAGITVRMVTGDNINTAKAIARECGILTEGGLAIEGPDFRTKSAEEMFKLIPKIQVMARSSPLDKHTLVKNLRTTHEEVVAVTGDGTNDAPALHEADIGLAMGIAGTEVAKESADVIILDDNFSTIVTVAKWGRSVYINIQKFVQFQLTVNVVALVVNFSSACLTGSAPLTAVQLLWVNMIMDTLGALALATEPPNNELMKRTPVGRKGNFISNVMWRNIMGQAIYQFFVIWYLQTEGKTLFELKGDNSDLVLNTLIFNCFVFCQVFNEVSSREMERINVFKGILDNNVFVAVLGSTVIFQIIIVQFLGDFANTTPLSLKEWFSCIVIGFIGMPIAAIVKLFPVGSQ

SEQ ID NO: 773 - protein, 1020 aa, Cocos nucifera
METYLKHNFSGVKSKNSSAEALERWRKVCGVVKNPKRRFRFTANLSKRNEAAAMKRTNKEKLRVAVLVSKAALQFIQGVPLSSEYTVPEEVKAAGFQICADELGSIVEGHDVKKLKMHGGIDGIANKLCTSTTNGLVAAEDRLIRRQEIYGINKFTESPVRSFWVFVWEALQDMTLIILAVCAFVSLIVGIATEGWPKGAHDGLGIVASILLVVFVTAMSDYRQSLQFKDLDKEKKKISIQVMRDGFRQKMSIYDLLPGDIVHLAIGDQVPADGLFISGFSVLIDESSLTGESEPVIVNKENPFLLSGTKVQDGSCIMLVTAVGMRTQWGKLMATLSEGGDDETPLQVKLNGVATIIGKIGLFFAVVTFAVLAEGQIRCKILDGSYLSWSGDDALELLEFFAIAVTIVVVAVPEGLPLAVTLSLAFAMKKMMNDKALVRHLAACETMGSATSICSDKTGTLTTNHMTVVKACICGDIKEVSNPEKVSSMGSQLPDVVVKILLQSIFNNTGGEVVVNQDGKLEILGTPTESALLEFALSLGGDFQAVRRETKLVKLEPFNSTKKRMGVVLQLPEGRLRAHSKGASEIILAACDKVLDPAGNAVPLDAAAVRHLNDTIESFANEALRTLCLAYMEIENSFSAEEQIPIEGYTCIGIVGIKDPVRPGVKESVAICRSAGVTVRMVTGDNINTAKAIARECGILTDDGVAIEGPEFREKSLEEMNDLIPKLQVMARSSPLDKHTLVKHLRTMFNEVVAVTGDGTNDAPALHEADIGLAMGIAGTEVAKESADVIILDDNFSTIVTVAKWGRSVYINIQKFVQFQLTVNMVALVVNFSSACLTGNAPLTAVQLLWVNMIMDTLGALALATEPPNEGLMKRAPVGRKGSFISNVMWRNILGQAFYQFIIIWYLQTEGKGLFQLEGPDSDLTLNTLIFNSFVFCQVFNEISSREMEKINVFQGILENYVFVAVITTTVIFQFVIVQFLGDFASTIPLTFNQWIFSVFIGFLGMPIAAAIKMIPVGSR

SEQ ID NO: 774 - protein, 1020 aa, Cocos nucifera
METYLKHNFSGVKSKNSSAEALERWRKVCGVVKNPKRRFRFTANLSKRNEAAAMKRTNKEKLRVAVLVSKAALQFIQGVPLSSEYTVPEEVKAAGFQICADELGSIVEGHDVKKLKMHGGIDGIANKLCTSTTNGLVAAEDRLIRRQEIYGINKFTESPVRSFWVFVWEALQDMTLIILAVCAFVSLIVGIATEGWPKGAHDGLGIVASILLVVFVTAMSDYRQSLQFKDLDKEKKKISIQVMRDGFRQKMSIYDLLPGDIVHLAIGDQVPADGLFISGFSVLIDESSLTGESEPVIVNKENPFLLSGTKVQDGSCIMLVTAVGMRTQWGKLMATLSEGGDDETPLQVKLNGVATIIGKIGLFFAVVTFAVLAEGQIRCKILDGSYLSWSGDDALELLEFFAIAVTIVVVAVPEGLPLAVTLSLAFAMKKMMNDKALVRHLAACETMGSATSICSDKTGTLTTNHMTVVKACICGDIKEVSNPEKVSSMGSQLPDVVVKILLQSIFNNTGGEVVVNQDGKLEILGTPTESALLEFALSLGGDFQAVRRETKLVKLEPFNSTKKRMGVVIQLPEGELRAHSKGASEIILAACDKVLDPAGNAVPLDAAAVRHLNDTIESFANEALRTLCLAYMEIANNFSAEDQIPVEGYTCIAIVGIKDPVRPGVKESVAICRSAGITVRMVTGDNINTAKAIARECGVLTDDGIAIEGPEFRNKSLEEMNDLIPKLQVMARSSPLDKHTLVKHLRTMFNEVVAVTGDGTNDAPALHEADIGLAMGIAGTEVAKESADVIILDDNFSTIVTVARWGRSVYINIQKFVQFQLTVNVVALIVNFSSACLTGNAPLTAVQLLWVNMIMDTLGALALATEPPNEGLMKRAPVGRNGNFISNIMWRNILGQAFYQFIVIWYLQTEGKGLFQLEGPDSDITLNTLIFNSFVFCQVFNEISSRDMEKIDVFHGILENYVFVAVITTTVIFQFVIVQFLGDFASTIPLTFNQWIFSVFIGFLGMPIAAAIKMIPVGSK

SEQ ID NO: 775 - protein, 1019 aa, Chelidonium majus
MESYLNENFGGVLAKNSSDEALQRWRKVCGFVKNPKRRFRFTANLSKRYEAEAMRKTNQEKLRVAVLVSKAALQFIHGITLPSEYIVPDDVKAAGFQVCAEELGNVVEGHDVKKLKVHGGVEGIANKLCTSTTTGLSTDADLLNRRQELYGINKFTESQQRSFLVFVWEALQDTTLIILGVCAFVSLIVGIVMEGWPKGAHDGLGIVASILLVVFVTATSDYRQSLQFKDLDKEKKKISIQVTRNGYRQKLSIYDLLPGDIVHLGIGDQVPADGLFISGFSVSINESSLTGEAEPVMVSSDYPFLLSGTKVQDGSCKMLVTTVGMRTQWGKLMATLSEGGDDETPLQVKLNGVATIIGKIGLFFAVVTFAVLVQTLFTRKLRDGTYLSWSGDDALEMLEYFAIAVTIVVVAVPEGLPLAVTLSLAFAMKKMMNDKALVRHLAACETMGSATSICSDKTGTLTTNHMAVVKACICGNIKEINNSKEALTLCSEIPDDSVKTLLQSIFTNTGGEVVINKDGKQEILGSPTETALLEFGLSLGGDFQAERQACKIVKVEPFNSEKKRMGVVLELPEGGLRAHCKGASEIILAACDKVIDPKGEVIPLDESSINHLNDVIEQFAGEALRTLCLAYIEMGNEFSCKEPIPLKGYTCIGIVGIKDPVRPGVRESVAICRSAGITVRMVTGDNITTAKAIARECGILTDGGIAIEGPVFREKSLEELQELIPKIQVMARSSPLDKHTLVRHLRTTFDEVVAVTGDGTNDAPALHEADIGLAMGIAGTEVAKESADVIILDDNFSTIVTVAKWGRSVYINIQKFVQFQLTVNVVALVVNFSSACLTGNAPLTAVQLLWVNMIMDTLGALALATEPPNDELMKRTPVGRRGNFISNVMWRNIMGQSLYQFVVIWYLQVAGKSLFNLDGPESDLILNTLIFNSFVFCQVFNEISSREMEKIDVFKGILENNVFVAVLTATVVFQIIIIEFLGTFANTSPLTYQQWFFSVFIGFLGMPIAALVKMIPVGI

SEQ ID NO: 776 - protein, 1007 aa, Ananas comosus
KSKHSSDEVLQRWRKLCGVVKNPKRRFRFTANLSKRSEARAMKRSNQEKLRVAVLVSKAALQFIHGITLHSEYTVPAEVKAAGFEICAEELSSIVEGHDLKKLKAHGGVAGVADKLSTSTNDGLITQEDRITVRQQIYGINKFAESQARSFWVFVWEALQDMTLIILAVCALVSLIVGIATEGWPKGAHDGLGIVASILLVVFVTATSDYRQSLQFKDLDKEKKKISIQVTRDGFRQKISIYDLLPGDVVHLAIGDQVPTDGLFISGFSLLINESSLTGESEPVAVSTENPFLLSGTKVQDGSCKMLVTTVGMRTQWGKLMATLSEGGDDETPLQVKLNGVATIIGKIGLFFAVVTFAVLSEGLIRHKFRDGSYFSWSGDDALELLEFFAIAVTIVVVAVPEGLPLAVTLSLAFAMKKVMNDKALVRHLAACETMGSATTICSDKTGTLTTNHMTVVKACVCGNIKEVSNSKEAISICSDIPDSVVKILLQSIFNNTGGEVVTNQDGKLEILGTPTETALLEFGLSLGGNFQVVRKESSLIKVEPFNSLKKRMGVVLQLPGGIYHAHTKGASEIILAACDKVLDSTGNAVPLDETAVSHLKGTIESFANEALRTLCLAYMEIENGFSVGEQIPLSGYTCIGIVGIKDPVRPGVKESVAICRNAGITVRMVTGDNINTAKAIARECGILTDDGLAIEGPEFRTKSLEELNALIPKLQVMARSSPLDKHNLVKHLRTTFDEVVAVTGDGTNDAPALHEADIGLAMGIAGTEVAKESADVIILDDNFSTIVTVGKWGRSVYINIQKFVQFQLTVNVVALIVNFSSACLTGNAPLTAVQLLWVNMIMDTLGALALATEPPNNDLMKRAPVGRKGNFISNVMWRNILGQALYQFVVIWYLQTEGKGLFRLEGLNSDATLNTLIFNSFVFCQVFNEISSREMEKINVFEGILENCVFVAVIVSTVIFQFIIVQFLGDFANTTPLTFMQWFTSIFVGFLSMPIAAAVKLIPVDA

SEQ ID NO: 777 - protein, 1019 aa, Aquilegia formosa
MESYLNENFGGVKPKNSSDEALERWRKLCGFVKNPKRRFRFTANLSKRYEAQAMRRTNQEKLRVAVLVSKAALQFIHGITLSSEYNVPEEVKAAGFQIDAEELGSIVEGHDVKKLKVHGGVEGIVDKLCTSTANGLTTTGDLLSRRQEIYGINKFTESEVRSFWVFVWEALQDMTLMILGVCAFVSLIVGLIMEGWPKGAHDGLGIAASILLVVFVTATSDYRQSLQFKDLDKEKKKITIQVTRNGYRQKISIYDLLPGDIVHLAIGDQVPADGLFVSGFSLSINESSLTGESDPVMVNAQNPYMLSGTKVQDGSCKMLVTTVGMRTQWGKLLATLSEGGDDETPLQVKLNGVATIIGKIGLFFAVVTFAVLVQGLFSRKWQDGTYLWWSGDDALALLEFFAVAVTIVVVAVPEGLPLAVTLSLAFAMKKMMNDKALVRHLAACETMGSATSICSDKTGTLTTNHMAVVKTCICGKVKEMNSSDEVFTLCSEVPSTTLKTLLQSIFNNTGGEVVVNKNGKREILGTPTETALLEFGLSLGGDFKAERESAKLVKVEPFNSEKKRMGVVLELPEGGLRAHCKGASEIILDACDKFIDSNGEVVRLDEATLNHLNNTIEQFANEALRTLCLAYMELGNDYSDKDSIPLKGYTCIGIVGIKDPVRPGVKESVAICRSAGITVRMVTGDNINTAKAIARECGILTDGGIAIEGPVFREKSLEELQEIIPKLQVMARSSPLDKHTLVKHLRTTFGEVVAVTGDGTNDAPALHEADIGLAMGIAGTEVAKESADVIILDDNFSTIVTVAKWGRSVYINIQKFVQFQLTVNVVALIVNFSSACLTGSAPLTAVQLLWVNMIMDTLGALALATEPPNDELMKRTPVGRKGNFISNVMWRNILGQSLYQFVVIWYLQTRGKALFSLDGPGSDLILNTLIFNSFVFCQVFNEISSREMEKIDVFEGILDNNVFVTVLSATCIFQIIIIEFLGTFANTHPLSFSQWFLSVFLGFLGMPIAAAVKMIPVGV

SEQ ID NO: 778 - protein, 915 aa, Triticum aestivum
VVESHDIKKLKAHGGTEGLLSKVSTSESDGVSTSKDKLASRQEIFGINKFAETEARSFWVFVWEALHDMTLMILAACAFFSLVVGIATEGWPKGAHDGLGIVASILLVVFVTATSDYRQSLQFKDLDKEKKKITVQVIRSGYRQKLSIYELLVGDIVHLSIGDQVPADGLFVSGFSLLINESSLTGESEPVAVNAENPFLLSGTKVQDGSCKMLVTTVGMRTQWGKLMATLSEGGDDETPLQVKLNGVATIIGKIGLVFAVVTFAVLTESLFRRKIMDGSYLSWSGDDALELLEFFAIAVTIVVVAVPEGLPLAVTLSLAFAMKKMMNDKALVRHLAACETMGSATSICSDKTGTLTTNHMTVVKACICGKIKEVEKSSDAKSLFSELPDSVMTMLSQSIFNNTGGDVVINQDGKREILGTPTEAAILELGLSLGGDFQAVRKATTLIKVEPFNSAKKRMGVVIQLPGGAFRAHCKGASEIILASCSKYLNDQGNAVPLDSATVAHLNATIESFANEALRTLCLAYIEVADGFSANDAIPEEGYTCIGIVGIKDPVRPGVKESVAICRSAGITVRMVTGDNINTAKAIARECGILTEGGLAIEGPDFRTKSAEEMYKLIPKIQVMARSSPLDKHTLVKNLRTTHEEVVAVTGDGTNDAPALHEADIGLAMGIAGTEVAKESADVIILDDNFSTIVTVAKWGRSVYINIQKFVQFQLTVNVVALVVNFSSACMTGSAPLTAVQLLWVNMIMDTLGALALATEPPNDELMKRTPVGRKGNFISNIMWRNIMGQAIYQFFVIWYLQTEGKTLFELKGDNSDLVLNTLIFNCFVFCQVFNEVSSREMERINVFRGILDNNVFVAVLGSTVLFQIIIVQFLGDFANTTPLSLREWFSCIVIGFIGMPIAAIVKLFPVGSQ

SEQ ID NO: 779 - protein, 1019 aa, Papaver somniferum
MESYLNENFGGVLAKNSSEEALQRWRKLCGFVKNPKRRFRFTANLSKRYEAEAMRRTNQEKLRVAVLVSKAALQFIHGVTFPTEYIVPDDVKAAGFQICAEELGSVVEGHDVKKLKVHGGVEGIANKLCTSTTTGLSADADLLDRRQGLYGINKFTENQLRSFWVFVWEALQDTTLIILAFCAFVSLMVGIATEGWPQGAHDGLGIVASILLVVFVTATSDYRQSLQFKDLDKEKKKISMQVTRNGYRQKMSIYDLLPGDIVHLGIGDQVPADGLFISGFSLSINESSLTGEAEPVMVSADHPFLLSGTKVQDGSCKMLVTTVGMRTQWGKLMATLSEGGDDETPLQVKLNGVATIIGKIGLFFAVVTFAVLVQTLFTRKIRDGTHWSWTGDDALEMLEYFAIAVTIVVVAVPEGLPLAVTLSLAFAMKKMMNDKALVRHLAACETMGSATTICSDKTGTLTTNHMAVVKACICGNIKEINSPNEALSLCSEIPDAAVKTLLQSIFTNTGGEVVINQDGKQEILGSPTETAILEFGLSLGGDFQAERGAAKTVKVEPFNSEKKRMGVVLELPEGGLRAHCKGASEIILAACDKVIDPRGEVVPLDEITINRLNDTIEQFAGEALRTLCLAYMEMGTDYSAKDPIPLRGYTCIGIVGIKDPVRPGVKESVAICRAAGIMVRMVTGDNITTAKAIARECGILTDDGIAIEGPVFREKSLEELEKLIPKIQVMARSSPLDKHMLVRHLRTTFGEVVAVTGDGTNDAPALHEADIGLAMGIAGTEVAKESADVIILDDNFSTIATVAKWGRSVYINIQKFVQFQLTVNVVALIVNFTSACLTGSAPLTAVQLLWVNMIMDTLGALALATEPPNEELMKRTPVGRTGNFISNVMWRNIMGQSLYQFAVIWYLQVAGKTVFNLDGPESDLILNTLIFNSFVFCQVFNEISSREMEKIDVFKGILENYVFVAVLSCTVVFQIIIIEFLGTFANTSPLTLTQWFFSVFIGFLGMPIAAVVKMIPVGI

SEQ ID NO: 780 - protein, 1018 aa, Amborella trichopoda
MESYLNENFGGVRPKHSSEEALRRWRRLCGIVKNPKRRFRFTANLSKRSEAQAMRKTNQEKLRVAVLVSKAALQFINGITFSGEYIVPSGVKAAGFGICADELGSIVEGHDVKKLKVHGGIEGLANKLSTSTTDGIITTDDNKLKTRQEIYGVNRFTESPPRGFWVFVWEALQDMTLMILAVCAFVSLLVGIATEGWPKGAHDGIGIVLSILLVVFVTATSDYRQSLQFKDLDKEKKKISIQVTRNGYRQKLSIYDLLPGDIVHLSIGDQVPTDGLFIFGFSVLINESSLTGESEPVTVNKDNPFLLSGTKVQDGSCKMLVTTVGMRTQWGKLMATLSEGGDDETPLQVKLNGVATIIGKIGLFFAVITFAVLVQSLLSKKIQEGRQWIWTGDEALEMLEYFAIAVTIVVVAVPEGLPLAVTLSLAFAMKKMMNDKALVRHLAACETMGSATGICSDKTGTLTTNHMTVVKACICGNIKEVGSSEEARNMCSHIPDSALKLLLESIFNNTGGDVVITQDGKLEILGTPTETAILEFGLSLGGNFEAERQECSLLKVEPFNSAKKRMAVVIQLPNGELRAHCKGASEIILDACDKVIDPTGKVVPLDEATMNHLKNTIESFASEALRTLCLAYVELENSFPIGDQIPLDGYTCIGIVGIKDPVRPGVKQSVEICRSAGITVRMVTGDNISTAKAIARECGILTDGGVAIEGPEFRKKSQEELNELIPKIQVMARSSPLDKHTLVKQLRTTFNEVVAVTGDGTNDAPALHEADIGLAMGIAGTEVAKESADVIILDDNFSTIVTVAKWGRSVYTNIQKFVQFQLTVNVVALIVNFSSACLTGKAPLTAVQLLWVNMIMDTLGALALATEPPQDDLMKRAPVGRKGNFISNVMWRNILGQAVYQFTVIRYLQTEGKGIFRLAGPDTDPVLNTLIFNSFVFCQVFNEINSREMEKINVFKGILDNYVFVAVLSCTVVFQVIIIEYLGTFANTIPLTLTQWFASILIGFLGMPIAAMIKKIPV

SEQ ID NO: 781 - protein, 1020 aa, Musa acuminata
MESYLNENFGGVKSKNSTEESLERWRKLVGVVKNPKRRFRFTANLSKRSEAAAMKRSNHEKLRVAVLVSKAALQFIHGIALHSEYIVPDEVKKAGFQICPDELGSIVEGHDVKKLKVHGGVNGIADKLSTSTTNGLIATEESLKHRQDIYGVNKFTESQVRSFWIFVWEALQDMTLIILAVCACISLIVGIATEGWPKGAHDGLGIVASILLVVFVTATSDYRQSLQFKDLDKEKKKISVQVTRDGFRQKISIYDLLPGDLVHLAIGDQVPADGLFMSGFSLLINESSLTGESEPVNVNADNPFLLSGTKVQDGSCKMLVTTVGMRSQWGKLMATLSEGGDDETPLQVKLNGVATIIGKIGLVFAVVTFAVLAEGLIKHKFQHGSYLSWSADDALELLEYFAVGVTIVVVAVPEGLPLAVTLSLAFAMKKMMNDRALVRHLAACETMGSATSICSDKTGTLTTNHMTVVKACICGNIKEVNNHEEIKHVCSQVPDVALKVLMQSIFYNTGGEVVINQAGKLEILGTPTETALLEFGLLLGGDFQVARQETKIVKVEPFNSEKKRMGVVLQLPGGGYRAHCKGASEIILAACDKVLDSAGNTVLLDESTFSQLKSTIESFASEALRTLCLAYMEIENGFTADEQIPINGFTCIGIVGIKDPVRPGVKDSVAICRSAGITVRMVTGDNINTAKAIARECGILTDDGVAIEGPDFRSKSLEEMMDLIPRLQVMARSSPMDKHTLVKHLRTMFNEVVAVTGDGTNDAPALHEADIGLAMGIAGTEVAKESADVIILDDNFSTIVTVAKWGRSVYINIQKFVQFQLTVNVVALIVNFSSACITGHAPLTAVQLLWVNMIMDTLGALALATEPPNDELMKRSPVGRKGGFISNTMWRNILGQALYQFIVIWYLQREGKGLFQLEGPDSDLALNTLIFNSFVFCQVFNEISCREMEKIDVFHGILENYVFVAVITCTIIFQFIIVQFLGEFANTTPLTLYQWFACVFIGFLGMPISAAIKMVPVGSK

SEQ ID NO: 782 - protein, 577 aa, Sorghum bicolor
METVKGWVAANYAEAMASMQHSLRVAYVVFSFCAAFFLGGIKAMVVGPVAAALMIVGNVGVILVLFPAHVWWTIYSLVKTDRVNTGLKLAVLFTLPVLFGLWLGLGIFGSALVALGYGFFTPWISTFEAFRQESEAKKFVHGIVDGTWGTIKGSCTVVRDFADICFHSYPVYLKELRESCQNREPHSIRLLDVPSCIVVALLGLIVDIPLYTVIALIKSPYMLFKGWQRLLHDLISREGPFLETVCVPIAGLAILFWPLVVVGSVLLAIVSSIFVGLYGAVIVFQEKSFQRGVSYVVAMVAEFDEYTNDWLYLREGTVLPKPSYRKRKSSNSTEFSVRTNASVKGTGPSEAPAMLVPNLAPARSVREAIQEVKMVQIWENMMKSCEQRGRDLLNLNVITTAALTEWLRAKESSHETISLGLPSYSLLCTVLQSIKAGSGGLVLGNFEVNQHNRPQDRLLDWFFHPVLVLKEQIQALKMTEEEVRFLEKLTVFVGNAAASAGGWDNGVQMPQDPVRLAQIQAISRRLVGIVRSMSKFPTYRRRYRNVVKLLIAYSIERESSSASGHSASYFEITQLDV

SEQ ID NO: 783 - protein, 583 aa, Setaria italica
MDSAKAWVAANYAEPMASMQHSLRVAYVVFSFCAAFFLGGIKAMVVGPVAAALMILGNVSVILVLFPAHVWWTIYSLIKTDRINAGLKLAVLLALPVLFGLWLGLSIFGGALVALGYGFFTPWISTFEAFRQESEAKKFVHGIVDGTWGTIKGSCTVVRDFADICFHSYPVYLKELRESSHNREPHSIRLLDVPSCIVVALLGLVVDIPLYTVIALIKSPYMLFKGWQRLLHDLISREGPFLETVCVPIAGLAILFWPLVVVGSVLLAIVSSIFVGLYGAVIVFQEKSFQRGVSYVVAMVAEFDEYTNDWLYLREGTILPKPSYRKRKSSNSTEFSVRTNASVKGAEYPSGSGEAPAMLVPNLAPARSVREAIQEVKMVQIWEGMMKACEQRGRDLLNLNVITAVGLSEWLRAKESGHETISLGLPSYSLLCTVLQSIKAGAGGLLLGNVEVNQHNRPQDRLLDWFFHPVLVLKEQIQALKMTEEEVRFLEKLTLFVGNAASTSVWDNGAEMPQDPVRLAQIQAISRRLVGIVRSLSKFPTYRRRYRHVVKLLIAYSIERDGSCRSSASSHSVSFFEITQLDV

SEQ ID NO: 784 - protein, 583 aa, Panicum virgatum
MDSVKAWAAANYAEPMTSMQQSLRVAYVVFAFCAAFFLGGIKAMVVGPVAAALMILGNVGVILVLFPAHVWWTIYSLIKTDRINAGLKLAVLLALPVLFVLWLGLGIFGSALAALGYGFFAPWISTFEAFRQESEAKKFVHGIVDGTWGTIKGSCTVVRDFADMCFHSYPVYLKELRESSQDREPHSIRLLDVPSCIVVALLGLVVDISLYTVIALIKSPYMLFKGWQRLLHDLISREGPFLETVCVPIAGLAILFWPLVVVGSVLLAIVSSIFVGLYGAVIVFQEKSFQRGVSYVVAMVAEFDEYTNDWLYLREGTILPKPSYRKRKSSNSTEFSVRTNASVKGAEYPSGSSEAPAMLVPNLAPARSVREAIQEVKMVQIWENTMKACEQRGRDLLNLNVITAVGLSEWLRGKESGHETISLGLPSYSLLCSVLQSIKAGAGGLLMGNVEVNQFNRPQDRLLDWFFHPVLVLKEQIQVLNMTEEEVRFLEKLTLFVGNAASASGWDNGAEVPQDPVRLAQIQAISRRLVGIVRSLSKFPTYRRRYRHVVKLLIAYSIERDGSCRSSASNHSVSFFEITQVDV

SEQ ID NO: 785 - protein, 583 aa, Oryza sativa
MDKVKAWAGANYAEPMGSVEQSLRVAYVVLSFCAAFFLGGIKAAVVGPVAAALMVLGNVGVILLLFPAHVWWTIYSLIKTERINAGLKLAVLIALPVLFGLWLGLGIFGSALVALGYGFFTPWIATFEAFRQESESKKFVHGVVDGTWGTIKGSCTVVRDFADLCFHSYPVYLKELRESSQNCEPHSIRVLDVPSCIAVGLLGLIVDIPLYTVIALIKSPYMLFKGWQRLLHDLISREGPFLETVCVPIAGLAILFWPLVVVGSVLLAIVSSIFVGLYGAVVVYQEKSFQRGVSYVVAMVAEFDEYTNDWLYLREGTVLPKPSYRKRKSSSSTEFSVRTNASVKGGDQPSSNEAPAMLVPTLAPARSVREAIQEVKMVQIWENMMKNCELRGRDLLNLNVITTVDLTEWLRTKESGHEAIGLGVPSYSLLCMILHSIKAGSGGLLIGNGIEINQYNRPQDRLIDWFLHPVLVLKDQIQALKMTEEEVRFLEKLTLFIGNSERANGWDNGAEIPQDPVRAGQIQAISRRLVGIVRSMSKFPTYRRRHRHVMKLLVTYSVEKEGSFRSSASNRSVPIFEITQLEV

SEQ ID NO: 786 - protein, 583 aa, Brachypodium distachyon
MGTVKAWVADNYAEAMASMQNSLRVAYVVFSFCAAFFLGGIKAMVVGPVAAALMILGNVGVILVLFPAHVWWTIYSLIKTDRINAGLKLAGLIALPVLLGLWLGLGIFGSALVALGYGFFTPWISTFEAFRQESDAKKFVHGIVDGTWGTIKGSCTVVRDFADICFHSYPVYLKEFRQCSHNRQPHSIRLLDVPSCIAVGLLGLAVDIPLYTVIALVKSPYMLFKGWQRLLHDLISREGPFLETVCVPIAGLAILFWPLVVVGSVLMAVVSSIFVGLYGAVIVYQEKSFRRGISYVVTMVAEFDEYTNDWLYLREGTVLPKPSYRKRKLPDSAEFSLRATVSVKGGEHPAASGEAPAMLVPALVPARSVREAIQEVKMVQIWENIMKSCELRGRDLLNLNVITTVDLTEWLRTKDGNNDTIDLGLPSYALLCTVLQSIKAGSGGLLLGNGVEVDQQNRPQDLLLDWFFHPVLVLKDQIQVLKMREEEVRFLEKSTLFVGNFASANAWDNGAEIPKDPVRTAQIQAISRRMVGIVRSMSKFPTYRRRYRHVVKLLVAYSVEREGSFGSSDSAQSISFEITRLDV

SEQ ID NO: 787 - protein, 587 aa, Secale cereale
MGTVKAWVAGKYAEPMGPMHDSLRVAYVVFSFCAAFLLGGIKAMVVGPVAAALMILGNVGVILVLFPAHVWWTIYSLIKTDRINAGLKLAVAIALPVLFGLWLGLGIFGSALVALGYGFFTPWISTFEAFRQESEAKKFVHGIVDGTWGTIKGSCTVVRDFADMCFHSYPVYLKELRECSQDREPLSIRLLDVPSCILVALLGLIVDIPLYTVIALIKSPYMLFKGWQRLLHDLISREGPFLEPVCVPIAGLAILFWPLVVVGSVLLAVVSSIFVGLYGAVIVFQEKSFRRGASYVVTMVAEFDEYTNDWLYLREGTVLPKPSYRKWKSSDSAEFSVRPNVSVRGGEHPSASSEAPAMLVPTLVPARSVREAIQEVKMVQIWENVMKSCEQRGRDLLNLNVITSVDLTEWLRTKDGGNETINLGLPSYDMLCTVMQSIKAGSAGLLIGNGVEVDQQNRPQDLLLDWFFHPVLVLKDQIQVLKMTEQEVRFLEKSTLFVGSGSAATASADAWDNGAETPRDPVRTAQIQAISRRMVGIVRSMSKFPTYRRRYRHVVKLLVAYAVEREGSFGSSASGPSVSFEITRLEV

SEQ ID NO: 788 - protein, 587 aa, Secale cereale
MGTVKAWVAGKYAEPMGPMHDSLRVAYVVFSFCAAFLLGGVKAMVVGPVAAALMILGNVGVILVLFPAHVWWTIYSLIKTDRINAGLKLAVAIALPVLFGLWLGLGIFGSALVALGYGFFTPWISTFEAFRQESEAKKFVHGIVDGTWGTIKGSCTVVRDFADMCFHSYPVYLKELRECSQDREPLSIRLLDVPSCILVALLGLIVDIPLYTVIALIKSPYMLFKGWQRLLHDLISREGPFLEPVCVPIAGLAILFWPLVVVGSVLLAVVSSIFVGLYGAVIVFQEKSFRRGASYVVTMVAEFDEYTNDWLYLREGTVLPKPSYRKWKSSDSAEFSVRPNVSVRGGEHPGASSEAPAMLVPTLVPARSVREAIQEVKMVQIWENVMKSCEQRGRDLLNLNVITSVDLTEWLRTKDGGNETINLGLPSYDMLCTVMQSIKAGSAGLLIGNGVEVDQQNRPQDLLLDWFFHPVLVLKDQIQVLKMTEQEVRFLEKSTLFVGSGSAATASADAWDNGAETPRDPVRTAQIQAISRRMVGIVRSMSKFPTYRRRYRHVVKLLVAYAVEREGSFGSSASGPSVSFEITRLEV

SEQ ID NO: 789 - protein, 586 aa, Triticum aestivum
MGTVKAWVAGKYAEPMGPMHDSLRVAYVVFSFCAAFLLGGIKAMVVGPVAAALMILGNAGVILVLFPAHVWWTIYSLIKTDRINAGLKLAVAIALPVLFGLWLGLGIFGSALVALGYGFFTPWISTFEAFRQESEAKKFVHGIVDGTWGTIKGSCTVVRDFADMCFHSYPVYLKELRECAQDREPLSIRLLDVPSCILVGLLGLIVDIPLYTVIALIKSPYMLFKGWQRLLHDLISREGPFLEPVCVPIAGLAILFWPLVVVGSVLLAVVSSIFVGLYGAVIVYQEKSFRRGASYVVTMVAEFDEYTNDWLYLREGTVLPKPSYRKRKSSDSAEFSVRPNVSVRGGEHPSSSSEAPAMLVPTLVPARSVREAIQEVKMVQIWENVMKSCEQRGRDLLNLNVITSVDLTEWLRTKDSGNETINLGLPSYDMLCTVLQSIKTGSAGLLLGNGVEVDQQNRPQDLLLDWFFHPVLVLKDQIQVLKMTEQEVRFLEKSTLFVGSSSATASADVWDNGAETPRDPVRTAQIQAISRRMVGIVRSMSKFPTYRRRYRHVVKLLVAYAVEREGSFGSSASGPSVSFEITRLEV

SEQ ID NO: 790 - protein, 472 aa, Setaria italica
MENKAGTEEALLLSRPENTVAAEAKRLLRLAGPLVASCILQNVVQLVSVMFVGHLGELPLAGASLASSLANVTGFSLLAGMASALDTLCGQAFGARQYGLLGVYKQRAMLVLALACVPIAVVWANAGQILALIGQDHDISAEAGAYSRWLILCLVPYVPLVCHVRFLQTQSIVVPVMVSSGVTALSHVFVCWALVFKAGMGSKGAALSNAIAYCVNLAMLALYVRLSGACTRTWTGFSTEAFKELRRFTDLAVPSAMMVCLEWWSFELLVLLSGLLPNPKLETSVLSICLNTGALMFMIPFGLCTAISTRVSNELGAGKPQAAKLATRVVMCIALSAGLLLASTMILLRNLWGYMYSNEPEVDTYIAKMIPVLAISFFTDGLHSSLSGVLTGCGEQKIGARVNLGAFYLAGIPMAVLLAFVLHLNGMGLWLGIVCGSLTKLVLLTWITLRINWDSEAIKAKETVFSSSLPIA

SEQ ID NO: 791 - protein, 472 aa, Panicum virgatum
MENKAETEEPLLLARPENTAAAEAKRLLRLAGPLVASCIMQNAVQLVSVMFVGHLGELPLAGASLASSLANVTGFSLLCGMVSALDTLCGQAFGARQYGLLGVYKQRAMLVLGLACVPIAVVWANAGRILILLGQDHDIAEEAGAYSRWLIPCLVPLVPLVCHIRFLQTQSIVVPVMASSGVTSLSHVFVCWALVFKAGLGSKGAALSNAISYCVNLAMLALYVRLSGACKRTWTGFSTEAFNELRRFTELAIPSAMMVCLEWWSFELLVLLSGLLPNPKLETSVLSICLNTGSLLFMIPFGLSTAISTRVSNELGAGQPHAAKLATRVVMCIAMSAGLVLASTMILLRNVWGYMYSNEPEVITYIAKMIPVLAISFFTDGLHSSLSGVLTGCGEQKVGARVNLGAFYLAGVPMAVFLAFVLHLNGMGLWLGIVCGSLTKLVLLMWITLRINWEKEATKAKETVFSSSLPIA

SEQ ID NO: 792 - protein, 450 aa, Sorghum bicolor
MDNKAATEEPLLVPRPEHTATSEAKRLLSLAGPLVASCILQNVVQLVSVMFVGHLGELPLAGASLASSLANVTGFSLLAGMASALDTLCGQAFGARQYGLLGVYKQRAMLVLALACLPIAVVWANAGRILVLLGQDRDIAAEAGAYSRWLILGLVPYVPLACHIRFLQTQSVVVPVMVSSGVTALGHAVVCWALVFKAGMGSKGAALSIAISYSFNLAMLALYVRFSSACKRTWTGFSTEAFKDLHRFTELAIPSAMMVCLEWWSFELLVLLSGLLPNPKLETSVLSICLNTGALLFMVPFGLCTAISTRVSNELGAGEPQAAKLATRVVMCIAFNEPEVVTYIARMIPVLAISFFTDGLHSCLSGVVTGCGEQKIGARVNLSAYYLAGIPMAVFLAFVLHLNGMGLWLGIVCGSLTKLVLLLWITLRINWEKEAIKAKETVFSSTLPIA

SEQ ID NO: 793 - protein, 472 aa, Aegilops tauschii
MEKPSVDEQPLLVERDENAAAPEAKRLLRLAGPLVASGILQCALQLVSVMFVGHLGELPLAGASLATSLANVTGFSLLVGMASALDTLCGQAFGARQYHLLGVYKQRAMLVLTLACVPIALVWANTARILLLLGQDTAIAAEAGAYARWLIPALVPYVPLTCHIRFLQTQSMVVPVMASSAVTSLSHVLVCWALVHRAGMGSKGAALATAVSYSANLAILSLYTRLSGVCKTTWTGFSMEAFKELRQFAELAVPSAMMVCLEWWSFELLMLLSGLLPNPKLETSVLSICLNTGALMFMVPSGLCTAISTRVSNELGAGRPQAAKLATRLVVCMALFAGSVISITMISLRKFWGYMYSNEEEVVTYIARMIPVLAISFFIDGIHTSLSGVLYGCGEQKIGARVNLAAFYLAGIPLAVLLAFVLHLNGMGLWLGIVCGSLTKLVLLMWIVLSINWEKEAMKAKDMVLGSSLPAA

SEQ ID NO: 794 - protein, 472 aa, Triticum aestivum
MEKPSVDEQPLLVERDENAAAPEAKRLLRLAGPLVASGILQCALQLVSVMFVGHLGELPLAGAALATSLANVTGFSLLVGMASALDTLCGQAFGARQYHLLGVYKQRAMLVLTLACVPIALVWANTARILLLLGQDTAIAAEAGAYARWLIPALVPYVPLTCHIRFLQTQSMVVPVMASSAVTSLSHVLVCWALVHRAGMGSKGAALATAVSYSANLAILSLYTRLSGVCKTTWTGFSMEAFKELRQFAELAVPSAMMVCLEWWSFELLVLLSGLLPNPKLETSVLSICLNTGALMFMVPSGLCTAISTRVSNELGAGRPQAAKLATRLVVCMALFAGSVISITMISLRKFWGYMYSNEEEVVTYIARMIPVLAISFFIDGIHTSLSGVLYGCGEQKIGARVNLAAFYLAGIPLAVLLAFVLHLNGMGLWLGIVCGSLTKLVLLMWIVLSINWEKEAIKAKDMVLGSSLPAA

SEQ ID NO: 795 - protein, 263 aa, Sorghum bicolor
MAGLFTEQAAVYAAARPAYPKDLFAKLSALTAHHRRAWDVGTGNGQAAIGVAEHYDSVVATDASVEQLRHATPHPRVRYLHTSDALPEDDLVAMLGGEASVDLITVALAVHWFDLPAFYGVACRVLRRPGGVIAVWGYNYRMSPVEDMMARFFDTTLPYWDPRARYCTDGYRDLPFPFEDIGLGKEGEPASLDMEQEMSFEGLIGVLRSWSAVTTAKQQQGVDLLGERVVKELEEGWGGASLVRKVTYKGFLLAGTPGPTADE

SEQ ID NO: 796 - protein, 260 aa, Setaria italica
MAGLFSKQAAVYAAARPAYPNDLFTKLAALTAHHCLAWDVGTGNGQAAIGVAEHYDSVLATDVSEDQLLHAAPHPKVRYLHTPDATPGEDLVATLGGEGSVDLITVAEAAHWFDLPAFYDVAHRVLRRPGGVIAVWGYNYRISPVEDMMTRFFNTTLPYWDPRARCCTDGYRDLPFPFVDIGLGREGEPASLDMEQEMSFEGLIGMLSSWSAVTTAKQQGVDLLGERVVKQLEEEWGGASLVRKVTFKAFLLAGTPRADD

SEQ ID NO: 797 - protein, 263 aa, Pennisetum glaucum
MAGLFSKQAVVYAAARPAYPKDVFTKLAALTAQHRLAWDVGTGNGQAAIDVAEHYDSVLATDVSEEQLLHAAPHPKVRYLHTPDATPGEDLIAMLGGEGSVDLITVAQAAHWFDLPAFYGVSRQVLRRPGGVIAVWGYNYRMSPVEDMMTCFFNTTLPYWDPRARCCIDGYRDLPFPFVDIGLGREGEPVSLDMEHEMSFEGLIGMLRSWSAVTTAKRQGVDLLGERVVKQLEEEWGGASLVRKVTFKAFLLAGTPRADEIDE

SEQ ID NO: 798 - protein, 530 aa, Sorghum bicolor
MAVSAARVAVATAVSLAVHWLLRSFLQAQHPALGLLLLAAVFLGIAATGNAGAANAPPGPAAVPVFGNWLQVGNDLNHRFLARLSARYGPVFRLRLGVRNLVVVSDPRLATEVLHTQGVEFGSRPRNVVFDIFTANGADMVFTEYGDHWRRMRRVMTLPFFTARVVQQYRDMWEAEMDAVVSDISGDGAAQQAGFVVRRRLQLMLYNIMYRMMFDARFDSVDDPMFVEATRFNSERSRLAQSFDYNYGDFIPILRPFLRGYLNKCKDLQTRRLAFFNNNYVEKRRKVMDTPGDKNKLRCAIDHILQAEKSGEITSENVIYIVENINVAAIETTLWSIEWALAEVVNHPAVQRKVRDEIKAVVGDDEPITESTIHRLPYLQAVIKETLRLHSPIPLLVPHMNLEEAKLGGYTIPKGSKVVVNAWWLANNPELWEKPEEFRPERFLGEEKSVDATVGGKVDFRFLPFGVGRRSCPGIILALPILALIVGKLVRSFEMVPPPGVEKLDVSEKGGQFSLHIAKHSVIAFHPVSA

SEQ ID NO: 799 - protein, 528 aa, Panicum virgatum
MVVSAARVAVATAASLAAHWLVHSFLQPCHHPALGLLLPAAVFLTIAVLGGGSAPPGPAAVPVFGNWLQVGNDLNHRFLARLSARYGPVFRLRLGVRNLVVVSDPRLAAEVLHTQGVEFGSRPRNVVFDIFTANGADMVFTEYGDHWRRMRRVMTLPFFTARVVQQYRGMWEAEMDAAVADISGDGAAQRGGFIVRRRLQLMLYNIMYRMMFDARFDSVDDPMFVEATRFNSERSRLAQSFEYNYGDFIPILRPFLRGYLDRCRDLQARRLAFFNNNYVEKRRKVMDTPGDKGKLRCAIDHILQAEKSGEITPENVIYIVENINVAAIETTLWSIEWALAEVVNHPAVQRKVRDEIRDVIGDDEPITESNIHRLPYLQAVIKETLRLHSPIPLLVPHMNLEEAKLGGYTIPKGSKVVVNAWWLANNPELWEKPEEFRPERFLGEEKAVDATVGGKVDFRFLPFGVGRRSCPGIILALPILALIVGKLVRSFEMVPPPGVEKLDVSEKGGQFSLHIAKHSVIAFHPISA

SEQ ID NO: 800 - protein, 532 aa, Setaria italica
MAVFAARFAVATVASFAVHWLVHSFLQYQHPALVLLLPVAVFVGIVATGSDSSGAGSAPPGPAAVPVFGNWLQVGNDLNHRFLARLSARYGPVFRLRLGVRNLVVVSDPRLATEVLHTQGVEFGSRPRNVVFDIFTANGADMVFTEYGDHWRRMRRVMTLPFFTARVVQQYRGMWEAEMDAVVADISADRAVAQTAGFVVRRRLQLMLYNIMYRMMFDARFDSVDDPMFVEATKFNSERSRLAQSFEYNYGDFIPILRPFLRGYLNKCRDLQTRRLAFFNNNYVEKRRKVMDTPGDKDKLRCAIDHILQAEKNGEITPDNVIYIVENINVAAIETTLWSIEWALAEVVNHPDVQRRVRDEIRGVIADDEPITESNIHKLPYLQAVIKETLRLHSPIPLLVPHMNLEEAKLGGYTIPKGSKVVVNAWWLANNPELWEKPEEFRPERFLGEEKAVDATVGGKVDFRFLPFGVGRRSCPGIILALPILALIVGKLVRSFEMVPPGVEKLDVSEKGGQFSLHIANHSVIAFHPISA

SEQ ID NO: 801 - protein, 534 aa, Hordeum vulgare
MTASASARRMAFAAAASLAVYWLLKSFLHTPHPALLPAAAALVALTITLGASGKGGGAGAPPGPAAVPVFGNWLQVGNDLNHRFLAGLSARYGPVFRLRLGVRNLVVVSDPRLATEVLHTQGVEFGSRPRNVVFDIFTANGADMVFTEYGDHWRRMRRVMTLPFFTARVVQQYRAMWEAEMDDVVSDLRGGSAARGPGVVVRRRLQLMLYNIMYRMMFDARFESVDDPMFVEATKFNSERSRLAQSFDYNYGDFIPILRPFLRGYLNKCRDLQTRRLAFFNSNYVEKRRKVMDTPGDKNKLRCAIDHILAAEKSGEITPENVIYIVENINVAAIETTLWSIEWALAEVVNHPDVQRKVRGEIRDVLGDDEPITESNISKLPYLQAVIKETLRLHSPIPLLVPHMNLEEASLGGYTIPEGSKVVVNAWWLANNPELWEKPEEFRPERFLGEESNVDATVGGKVDFRFLPFGVGRRSCPGIILALPILALIVGKLVRSFEMVPPPGVDKLDVSEKGGQFSLHIANHSLVAFHPISA

SEQ ID NO: 802 - protein, 534 aa, Aegilops tauschii
MAVSARSAAFATAASLAVYWLLTSFLHAPHPALLPAAAALVAVAIAAGAGRKRGGAGAPPGPAAVPVFGNWLQVGNDLNHRFLARLSARYGPVFRLRLGVRNLVVVSDPQLATEVLHTQGVEFGSRPRNVVFDIFTANGADMVFTEYGDHWRRMRRVMTLPFFTARVVQQYRSMWEAEMDDVVSDLRGDSAARGAGVVVRRRLQLMLYNIMYRMMFDARFESVDDPMFVEATKFNSERSRLAQSFDYNYGDFIPILRPFLRGYLNKCRDLQTRRLAFFNANYVEKRRKVMDTPGDKNKLRCAIDHILAAEKSGEITPENVIYIVENINVAAIETTLWSIEWALAEVVNHPEVQRKVRGEIRDVLGDDEPITESNISKLPYLQAVIKETLRLHSPIPLPPPHIPLEEPSLGGYTIPKGSKVVVNAWWLANNPELWEKPEEFRPERFLGEESNVDTTVGGGKVDFRFLPFGVGRRSCPGIILALPILALIVGKLVRSFEMVPPPGVDKLDVSEKGGQFSLHIANHSVVAFHPIVSP

SEQ ID NO: 803 - protein, 533 aa, Oryza sativa
MAASAMRVAIATGASLAVHLFVKSFVQAQHPALTLLLPVAVFVGIAVGAKGGSGGDGKAPPGPAAVPVFGNWLQVGNDLNHRFLAAMSARYGPVFRLRLGVRNLVVVSDPKLATEVLHTQGVEFGSRPRNVVFDIFTANGADMVFTEYGDHWRRMRRVMTLPFFTARVVQQYKAMWEAEMDAVVDDVRGDAVAQGTGFVVRRRLQLMLYNIMYRMMFDARFESVDDPMFIEATRFNSERSRLAQSFEYNYGDFIPILRPFLRGYLNKCRDLQSRRLAFFNNNYVEKRRKVMDTPGDRNKLRCAIDHILEAEKNGELTAENVIYIVENINVAAIETTLWSIEWALAEVVNHPAVQSKVRAEINDVLGDDEPITESSIHKLTYLQAVIKETLRLHSPIPLLVPHMNLEEAKLGGYTIPKGSKVVVNAWWLANNPALWENPEEFRPERFLEKESGVDATVAGKVDFRFLPFGVGRRSCPGIILALPILALIVGKLVRSFEMVPPPGVEKLDVSEKGGQFSLHIAKHSVVAFHPISA

SEQ ID NO: 804 - protein, 267 aa, Sorghum bicolor
MKFSTMRCCVLLVSLALLPLGMAADSIGSYCSGSRYAGSNKAVTSINSVLADLVATASTGGGYATSTAGKGNNIIYGLAQCRGDVSASDCAACLADAAKQLPSTCSYSSDARIWYDYCFMRYENADFFGQADTGAGVILVNVQAMDNPKAFEKAVGKVIGKATAQASAAGSAGLGRDKDQYTPFVSIYGLAQCTRDLAPLTCAQCLSTAVSRFGDYCGAQQGCQINYSSCRVRYEIYPFYFPLAGNGGAGGRATTDMTKNTKIIVHP

SEQ ID NO: 805 - protein, 264 aa, Echinochloa colona
MEFSTMRRFVLLVSLALLPLGMAADSIGSYCAGNSYAGSNKAVANINSVLADLVSTASTGGYATSTAGKGNNVIYGLAQCRGDVSAGDCAACLADAAKQLPSTCSYSSDARIWYDYCFMRYENANFIGQVDTDAGVILVNVQAMGNAKAFEKAVGKVVGKATAQASASGSAGLGRDKDQYTPFVTIYGLAQCTRDLAPLACAQCLSTAVSRFGNYCGAQQGCQINYSSCRVRYEIYPFYFPLAGNGGGRATTDMTKNTKIVVHP

SEQ ID NO: 806 - protein, 265 aa, Setaria italica
MEFSTMRRSCVLLVSLALLPVLGMAADSIGSYCAGNSYAGNNKAVASINSVLADLVATASTGGYATSTAGKGNNVIYGLAQCRGDVSAGDCAACLADAAKQLPATCSYSSDARIWYDYCFMRYENANFIGQADTDAGVILVNVQGMDNAKAFEKAVGKVVGKAAAQASASGSGGLGRDKDQYTAFVTIYGLAQCTRDLAPLACAQCLSTAVSRFGDYCRAQQGCQINYSSCRVRYEIYPFYFPLAGNAGRATTDMTKNTKIVVHP

SEQ ID NO: 807 - protein, 256 aa, Saccharum officinarum
MEFSTMRCCILLVSLALLPLGMAADSIGSYCSGSSYAGSNKAETSINSVLADLVATASTGGGYATSTAGKGNNIIYGLAQCRGDVSASDCAACLADAAKQLPSTCSYSSDARIWYDYCFMRYENANFFGQADTDAGVILVNVQAMDNPKAFEKAVGKVIGKATAQASAAGSAVLGRDKEQYTPFVSIYGLAQCTRDLAPVTCAQCLSTAVSRFRDYCGAQQGCQNNYSNCRGRYEIYPFYFPLAATAPADPPPRHD

SEQ ID NO: 808 - protein, 267 aa, Panicum virgatum
MEFIRGRARRCVALLVSMALLPLLGMAADSIGSYCAGSSYAGSSKAVASINSVLADLVATASTGGYATSTAGKGSAVIYGLAQCRGDVSAGDCAACLADAAKQLPSTCSYSSDARIWYDFCFMRYENADFVGQADTDAGVILVNVQAADNAKAFEKAVAKAVGKATAQASAAGSAGLGRGRDQYTAFVTVYGLAQCTRDLAPLACAQCLSTAVSRFGGYCGARQGCQINYSSCRVRYEIYPFYFPLAGDGRRAATDMTKNTKIVVHP

SEQ ID NO: 809 - protein, 79 aa, Brachypodium distachyon
MAASRFHIACALLLFGAVLLGQDGKAGMEAVACPQYCLEVEYTTCPSSGSEKLPARCNCCMAPKGCTLHLSDGTKQTCR

SEQ ID NO: 810 - protein, 847 aa, Setaria italica
MPSLSCHNLLDLAAADEVPLPSPTPLRLPRVMSVASPASPTSPPTPPRRVIVSHRLPLRAAPDPAAPFGFAFTVDAGTVAYQLRSGLPASAPVLHIGTLPAAAAEAASDELSNYLLANFSCLPVYLPSDLHHRFYHGFCKHYLWPLLHYLLPLTPSSLGGLPFQRTLYHSFLSANRAFADRLTEVLSPDEDLVWIHDYHLLALPTFLRKRFPRAKVGFFLHSPFPSSEIFRTIPVRDDLVRALLNADLVGFHTFDYARHFLSACSRLLGLDYQSKRGYIGIEYYGRTVTVKILPVGIDMGQLRSVVSAPETGDVVRRVAEAYKGRRLMIGVDDVDLFKGIGLKFLAMEQLLVEHPELRGRAVLVQIANPARSEGRDVQGVQDEAKAISARVNARFGTPGYTPIVLIDGPLTAHEKAAYYAAAECCVVSAVRDGLNRIPYIYTVCRQESNALGEDSPKRSVIVLSEFVGCSPSLSGAIRVNPWSVESVAEAMNAALRMPEAEQRLRHEKHYKYVSTHDVAYWARSFDQDLQRACKDHFSRRHWGIGFGMSFKVVALGPNFRRLSVEHIVPSYRRTENRLILLDYDGTVMPENSIDKTPSSEVISVLNRLCEDPKNRVFIVSGRGKDELSKWFAPCEKLGIAAEHGYFTRWSRDAPWETSVLAADFDWKKTAEPVMQLYTGATDGSYIEHKESAIVWHHHEADPDFGSCQAKELLDHLENVLANEPVVVKRGQHIVEVNPQGISKGVVVESLLSSMVKTGKPPDFVLCIGDDRSDEDMFESIVCPSNASVKLPATSEVFACTVGKKPSMAKYYLDDTVDVIKMLEGLANAPSQRPRPAVQLRVSFEGSL

SEQ ID NO: 811 - protein, 849 aa, Panicum virgatum
MPSLSCHNLLELAAADEAPLPSPTPLRLPRVMSVASPASPTSPSSPAPLRRVIVSHRLPLRAAPDPAAPFGFAFTVDSGTVAYQLRSGLTANAPVLHIGTLPAVAAEAASDELSNYLLANFSCLPVYLPSDLHHRFYHGFCKHYLWPLLHYLLPLTPSSLGGLPFQRTLYHSFLSANRAFADRLTEVLTPDEDLVWIHDYHLLALPTFLRKRFPRAKVGFFLHSPFPSSEIFRTIPVRDDLVRALLNADLVGFHTFDYARHFLSACSRLLGLDYQSKRGYIGIEYYGRTVTVKILPVGIDMGQLRSVVSAPETGDAVRRVTEAYKGRRLMIGVDDVDLFKGIGLKFLAMEQLLVDHPELRGRAVLVQIANPARSEGRDVQGVQDEARAISARVNARFGTPGYTPIVLLDGPVTPQEKAAYYAAAECCVVSAVRDGLNRIPYIYTVLRQESDALGDDTPKRSVIVLSEFVGCSPSLSGAIRVNPWSVESVAEAMNAALRMPEAEQRLRHEKHYKYVSTHDVAYWARSFDQDLQRACKDHFSRRHWGIGFGMSFKVVALGPNFRRLSVEHIVPSYRRTENRLILLDYDGTVMPENSIDKAPSSEVISVLNRLCEDPKNRVFIVSGRGKDELSKWFAPCEKLGIAAEHGYFTRWSRDAPWETSSLAADFDWKKTAEPVMQLYTEATDGSSIEHKESALVWHHQEADPDFGSCQAKELLDHLENVLANEPVVVKRGQHIVEVNPQGISKGVVVESLLSSMVKTGKAPDFVLCIGDDRSDEDMFESIVCPSNASVKLPATSEVFACTVGKKPSMARYYLDDTVDVIKMLEGLANAPSQRPRPAVQLRVSFEGSL

SEQ ID NO: 812 - protein, 849 aa, Panicum virgatum
MPSLSCHNLLDLAAADEVPLPSPTPLRLPRVMSVASPASPTSPSPPAPPRRVIVSHRLPLRAAPDPAAPFGFVFTVDSGTVAYQLRSGLPASAPVLHIGTLPAAAAEAASDELSNYLLANFSCLPVYLPSDLHHRFYHGFCKHYLWPLLHYLLPLTPSSLGGLPFQRTLYHSFLSANRAFADRLTEVLSPDEDLVWIHDYHLLALPTFLRKRFPRAKVGFFLHSPFPSSEIFRTIPVRDDLVRALLNADLVGFHTFDYARHFLSACSRLLGLDYQSKRGYIGIEYYGRTVTVKILPVGIDMGQLRSVVSAPETGDAVRRVAEAYKGRRLMIGVDDVDLFKGIGLKFLAMEQLLVDHPELRGRAVLVQITNPARSEGRDVQGVQDEARAISARVNARFGTPGYTPIVLLEGPVTPQEKAAYYAAAECCVMSAVRDGLNRIPYIYTVLRQESDALGDDAPKRSVIVLSEFVGCSPSLSGAIRVNPWSVESVAEAMNAALRMPEAEQRLRHEKHYKYVSTHDVAYWARSFDQDLQRACKDHFSRRHWGIGFGMSFKVVALGPNFRRLSVEHILPSYRRTENRLILLDYDGTVMPENSIDKAPSSEVISILNRLCEDPKNRVFIVSGRGKDELSKWFAPCEKLGIAAEHGYFTRWSRGVPWETSSLAADFDWKKTAEPVMRLYTEATDGSSIEHKESALVWHHQEADPDFGSCQAKELLDHLENVLANEPVVVKRGQHIVEVNPQGISKGVVVESLLSSMVKTGKAPDLVLCIGDDRSDEDMFESIVCPSNASVRLPATSEVFACTVGKKPSMARYYLDDTVDVIKMLEGLANAPSQRPRPAVQLRVSFEGSL

SEQ ID NO: 813 - protein, 850 aa, Setaria italica
MPSLSCHNLLDLAAADEVPLPSPTPLRLPRVMSVASPASPTSSPSPPATPRRVIVSHRLPLHAAPDPAAPFGFAFTVDAGTVAYQLRSGLPASAPVLHIGTLPAAAAEAASDELSNYLLANFSCLPVYLPSDLHHRFYHGFCKHYLWPLLHYLLPLTPSSLGGLPFQRTLYHSFLSANRAFADRLTEVLNPDEDLVWIHDYHLLALPTFLRKRFPRAKVGFFLHSPFPSSEIFRTIPVRDDLVRALLNADLVGFHTFDYARHFLSACSRLLGLDYQSKRGYIGIEYYGRTVMVKILPVGIDMGQLRSVVSAPETGDAVRRVAEAYKGRRLMIGVDDVDLFKGIGLKFLAMEQLLLEHPELRGRAVLVQIANPARSEGRDVQGVQDEAKAISARVNERFSTAGYTPIVLIDGLVTEQEKSAYYAAAECCVVSAVRDGLNRIPYIYTVCRQESNALGDDSPKRSVIVLSEFVGCSPSLSGAIRVNPWSVESVAEAMNAALRMPEAEQRLRHEKHYKYVSTHDVAYWARSFDQDLQRASKDHLSRRHWGIGFGMSFKVVALGPNFRRLYVKHIVPSYRKTENRLILLDYDGTVMPENSIDKTPSSEVISVLNCLCEDPKNRVFIVSGRGKDELSKWFAPCEKLGIAAEHGYFTRWSRDTPWETSVLAADFDWKKTAEPVMQLYTEATDGSYIEHKESAIVWHHHEADPDFGSCQAKELLDHLENVLANEPVVVKRGQHIVEVNPQGISKGVVADSLLSSMVKTGKPPDFVLCIGDDRSDEDMFESIVCPSNASVKLPATSEVFACTVGKKPSMAKYYLDDTVDVIKMLEALANATSQRPRLAVQLRVSFEGSL

SEQ ID NO: 814 - protein, 847 aa, Oryza sativa
MPSLSCHNLLDLVAAADDAAPSPASLRLPRVMSAASPASPTSPSTPAPARRVVVSHRLPLRAAADAASPFGFSFTVDSDAVAYQLRSGLPPGAPVLHIGTLPPPATEAASDELCNYLLANFSCLPVYLPADLHRRFYHGFCKHYLWPLLHYLLPLTPSSLGGLPFDRALYHSFLSANRAFADRLTEVLSPDDDLVWIHDYHLLALPTFLRKRFPRAKVGFFLHSPFPSSEIFRTIPVREDLLRALLNADLVGFHTFDYARHFLSACSRLLGLDYQSKRGYIGIEYYGRTVTVKILPVGIDMGQLRSVVSAPETGDLVRRLTESYKGRRLMVGVDDVDLFKGIGLKFLAMEQLLVEHPELRGRAVLVQIANPARSEGRDIQEVQGEARAISARVNARFGTPGYTPIVLIDRGVSVHEKAAYYAAAECCVVSAVRDGLNRIPYIYTVCRQESTGLDDAAKRSVIVLSEFVGCSPSLSGAIRVNPWSVESMAEAMNAALRMPEPEQRLRHEKHYKYVSTHDVAYWAKSFDQDLQRACKDHFSRRHWGIGFGMSFKVVALGPNFRRLSVDHIVPSYRKSDNRLILLDYDGTVMPEGSIDKAPSNEVISVLNRLCEDPKNRVFIVSGRGKDELGRWFAPCEKLGIAAEHGYFTRWSRDSAWETCGLAVDFDWKKTAEPVMRLYKEATDGSTIEDKESALVWHHDEADPDFGSCQAKELLDHLENVLANEPVVVKRGQHIVEVNPQGISKGVVVDNLLSSMVSRGKAPDFVLCIGDDRSDEDMFESIVCPSNSSVKLPASSEVFACTVGKKPSMAKYYLDDTVDVIKMLQGLANAPSQRPRQVQLRVSFEGSL

SEQ ID NO: 815 - protein, 851 aa, Brachypodium distachyon
MPSLSCHNLLDLANAATDELPPLPPPSPLRLPRVMASGSPSSPASPSPSAPPRRVIVSHRLPLRAAPDAAAPFGFSFTVDASTVAYQLRSGLPPSAPVLHIGTLPAAAAEDFSDELAAYLLANFSCLPVYLPADLHRRFYHGFCKHYMWPLLHYLLPLTPSTLGGLPFDRSLYHSFLSANRAFADRLTEVLSPDDDFVWIQDYHLFALPTFLRKRFPRAKVGFFLHSPFPSSEIFRTIPVRDDLLRALLNADLVGFHTFDYARHFLSACSRLLGLDYQSKRGYIGIEYYGRTVTVKILPVGIDMGQLRSVVSAPETGEVARQVAEAYKGRRLMLGVDDVDLFKGIGLKFLGMEQLLVEHPELRGRAVLVQIANPARSEGRDVQEVQDEARAISARVNERFGSPGYTPIVMINRPVSVHEKAAYYAAAECCVVSAVRDGLNRIPYIYTVCRQESTTQEEAPKRSVIVLSEFVGCSPSLSGAIRVNPWSVESVAEAMNAALMMSEGEQRLRHEKHYKYVSTHDVAYWARSFDQDLQRACKDHFSRRHWGIGFGMSFKVVALGPNFRRLSVEHIVPSFRKTDNRLILLDYDGTVMPESSIDKAPSNEVISVLNRLCEDPKNRVFIVSGRGKDELSKWFAPCEKLGIAAEHGYFTRWSKDSPWETCGLAVDFDWKKTAEPVMRLYTESTDGSYIEHKESALVWHHHEADPDFGSCQAKELLDHLESVLANEPVVVKRGQHIVEVNPQGISKGVVVESLLSSMVRSGKAPDFVLCIGDDRSDEDMFESIVCPTNSSVKLPATSEVFACTVGKKPSMAKYYLDDTVDVIKMLQGLANAPLQQRPWPVQLRVTFEGSL

SEQ ID NO: 816 - protein, 848 aa, Secale cereale
MPSLSCHNLLDLADELPPLPPSPLRLPRVMAAASPSSPASPAPQGPPRRVIVSHRLPLRASPDPAAPFGFKFTVDAGTVAYQLRSGLPPAAPVLHVGTLPPAAAEAASDELAAYLMANFSCLPVFLPADLHGKFYHGFCKHYMWPLLHYLLPLTPSTLGGLPFDRALYHSFLSANRAFADRLTEVLAPDDDFVWIQDYHLLALPTFLRKRFPRARVGFFLHSPFPSSEIFRTIPVRDDLLRALLNADLVGFHTFDYARHFLSACSRLLGLDYQSKRGYIGIEYYGRTVTVKILPVGIDMGQLRSVVSAPETADVVRQVADAYKGRRLMLGVDDVDLFKGIGLKFLGMEQLLVENPELRGKAVLVQITNPARSEGRDVQEVQDEARAISARVNERFGTPGYTPIVMISRPVSEHEKAAYYAAAECCVVSAVRDGLNRIPYIYTVCRQESTALGDAPKRSVIVLSEFVGCSPSLSGAIRVNPWSVESVAEAMSSALRMSDGEQRLRHEKHYKYVSTHDVAYWARSFDQDLQRACKDHFSRRHWGIGFGMSFKVVALGPNFRRLSVEHIVPSFRKTENRLILLDYDGTVMPESSIDKAPSSEVISVLNRLCEDPKNRVFIVSGRGKDELSKWFSPCEKLGIAAEHGYFTRWSKESPWETCGLVADFDWKKTAEPVMRLYTEATDGSYIEHKESALVWHHDEADPDFGSCQAKELLDHLESVLANEPVVVKRGQHIVEVNPQGISKGVVVESLLSSMVRGGKAPDFVLCIGDDRSDEDMFESIVCPANGRVKLPATSEVFACTVGKKPSMAKYYLDDTVDVIKMLQGLANALSQQRPWPVQLRVTFEEGNGV

SEQ ID NO: 817 - protein, 837 aa, Secale cereale
MPSLSCHNLLDLADELPPLPPSPLRLPRVMAAASPSSPASPAPQGPPRRVIVSHRLPLRASPDPAAPFGFRFTVDAGTVAYQLRSGLPPAAPVLHVGTLPPAAAEAASDDLAAYLMANFSCLPVFLPADLHGKFYHGFCKHYMWPLLHYLLPLTPSTLGGLPFDRALYHSFLSANRAFADRLTEVLAPDDDFVWIQDYHLLALPTFLRKRFPRARVGFFLHSPFPSSEIFRTIPVRDDLLRALLNADLVGFHTFDYARHFLSACSRLLGLDYQSKRGYIGIEYYGRTVTVKILPVGIDMGQLRSVVSAPETADVVRQVADAYKGRRLMLGVDDVDLFKGIGLKFLGMEQLLVENPELRGKAVLVQITNPARSEGRDVQEVQDEARAISARVNERFGTPGYTPIVMISRPVSEHEKAAYYAAAECCVVSAVRDGLNRIPYIYTVCRQESTALGDAPKRSVIVLSEFVGCSPSLSGAIRVNPWSVESVAEAMSSALRMSDGEQRLRHEKHYKYVSTHDVAYWARSFDQDLQRACKDHFSRRHWGIGFGMSFKVVALGPNFRRLSVEHIVPSFRKTENRLILLDYDGTVMPESSIDKAPSSEVISVLNRLCEDPKNRVFIVSGRGKDELSKWFSPCEKLGIAAEHGYFTRWSKESPWETCGLVADFDWKKTAEPVMRLYTEATDGSYIEHKESALVWHHDEADPDFGSCQAKELLDHLESVLANEPVVVKRGQHIVEVNPQGISKGVVVESLLSSMVRGGKAPDFVLCIGDDRSDEDMFESIVCPANGRVKLPATSEVFACTVGKKPSMAKYYLDDTVDVIKMLQGLANAPSQQRPWPVQ

SEQ ID NO: 818 - protein, 943 aa, Zea mays
MYLIFFHNGRGAQAHAYPGLPYLYHHLTSLTRPRHTSAVLIPRSFRSSPTPDRLPNPTHSSRRGASLLSSSCAIAAASTSATPTDRQEEEGAMPSISCHNLLDLAAADDVPLPSPTPLRLPRVMSVASPASPTSPPAPAPPRRVIVSHRLPLRASPDPAAPFGFAFSVDAGTVAYQLRSGLPANAPVLHIGTLPAAAAEAASDELSDYLLANFSCLPVYLPTDLHHRFYHGFCKHYLWPLLHYLLPLTPSSLGGLPFQRTLYHSFLSANRAFADRLTEVLCPDEDLVWIHDYHLLALPTFLRKRFPRAKVGFFLHSPFPSSEIFRTIPVRDDLVRALLNADLVGFHTFDYARHFLTACSRLLGLDYQSKRGYIGIEYYGRTVTVKILPVGIDMGQLRSVVSAPETEDAVRRVTEAYKGRRLMVGVDDVDLFKGIGLKFLAMEQLLVEHRELRGHAVLVQIANPARSEGRDVQGVQDEARAISARVNARFGTPGYTPIVLIDAPVTPQEKAAYYAAAECCVVSAVRDGLNRIPYIYTVCRQESTALGDDSPKRSVIVLSEFVGCSPSLSGAIRVNPWSVESVAEAMNAALRMPEAEQRLRHEKHYKYVSTHDVAYWARSFDSDLQRACKDHFSRRHWGIGFGMSFKVVALGPNFRRLSVEHIVPSYRRTDNRLILLDYDGTVMPENSIDRTPSSEVISVLNRLCEDPKNRVFIVSGRGKDELSRWFAPCEKLGIAAEHGYLTRWSRDAPWDTSGLAADFDWKKTAEPVMQLYTEATDGSYIEHKESAIVWHHHEADPDFGSCQAKELLDHLENVLANEPVVVKRGQHIVEVNPQGISKGVVVDSLLSSMVRTGKPPDFVLCIGDDRSDEDMFESIVCPASNSGVKLPASSEVFACTVGKKPSMARYYLDDTVDVVKMLDGLASAPSQQRSRPAVQLRVSFEGSL

SEQ ID NO: 819 - protein, 817 aa, Secale cereale
AASPSSPASPAPQGPPRRVIVSHRLPLRASPDPAAPFGFRFTVDAGTVAYQLRSGLPPAAPVLHVGTLPPAAAEAASDELAAYLMANFSCLPVFLPADLHGKFYHGFCKHYMWPLLHYLLPLTPSTLGGLPFDRALYHSFLSANRAFADRLTEVLAPDDDFVWIQDYHLLALPTFLRKRFPRARVGFFLHSPFPSSEIFRTIPVRDDLLRALLNADLVGFHTFDYARHFLSACSRLLGLDYQSKRGYIGIEYYGRTVTVKILPVGIDMGQLRSVVSAPETADVVRQVADAYKGRRLMLGVDDVDLFKGIGLKFLGMEQLLVENPELRGKAVLVQITNPARSEGRDVQEVQDEARAISARVNERFGTPGYTPIVMISRPVSEHEKAAYYAAAECCVVSAVRDGLNRIPYIYTVCRQESTALGDAPKRSVIVLSEFVGCSPSLSGAIRVNPWSVESVAEAMSSALRMSDGEQRLRHEKHYKYVSTHDVAYWARSFDQDLQRACKDHFSRRHWGIGFGMSFKVVALGPNFRRLSVEHIVPSFRKTENRLILLDYDGTVMPESSIDKAPSSEVISVLNRLCEDPKNRVFIVSGRGKDELSKWFSPCEKLGIAAEHGYFTRWSKESPWETCGLVADFDWKKTAEPVMRLYTEATDGSYIEHKESALVWHHDEADPDFGSCQAKELLDHLESVLANEPVVVKRGQHIVEVNPQGISKGVVVESLLSSMVRGGKAPDFVLCIGDDRSDEDMFESIVCPANGRVKLPATSEVFACTVGKKPSMAKYYLDDTVDVIKMLQGLANAPSQQRPWPVQLRVTFEEGNGV

SEQ ID NO: 820 - protein, 986 aa, Zea mays
MPSFPRANVVDKTRGPSPCAHAVTPPTLTSGSPRPCPFLLPRRSDTHTHIQLAIFVPPVLLPCPRPTSAFLSPETSAKVIDPSPTPTPTDRPPNEPDTPRRVAALLFSSCAIAAVSTSATPTDRQEEDEEAMPSLSCHNLLDLAAADEVPLPSPTPLRLPRVMSVASPASPTSPSPPAPPRRVIVSHRLPLRASPDPSAPFGFRFSVDAGTVAYQLRSGLPTNAPVLHIGTLPASAAEAASDELSNYLLANFSCLPVYLPTDLHHRFYHGFCKHYLWPLLHYLLPLTPSSLGGLPFQRTLYHSFLSANRAFADRLTEVLSPDEDLVWIHDYHLLALPTFLRKRFPRAKVGFFLHSPFPSSEIFRTIPVRDDLVRALLNADLVGFHTFDYARHFLSACSRLLGLDYQSKRGYIGIEYYGRTVTVKILPVGIDMGQLRSVVSAPETEDAVRRVTEAYKGRRLMVGVDDVDLFKGIGLKFLAMEQLLVEHRELRGRAVLVQIANPARSEGRDVQGVQDEARAISARVNARFGTPGYTPIVLIDGPVTPQEKAAYYAAAECCVLSAVRDGLNRIPYIYTVCRQESTALGDDAPKRSAIVLSEFVGCSPSLSGAIRVNPWSVESVAEAMNAALRMPEAEQRLRHEKHYKYVSTHDVAYWARSFDSDLQRACKDHFSRRHWGIGFGMSFKVVALGPNFRRLSVEHIVPSYRRTENRLILLDYDGTVMPENSIDRTPSSEVISVLNRLCEDPKNRVFIVSGRGKDELSRWFAPCEKLGIAAEHGYFTRWSRDAPWEASALAADLDWKNTAEPVMRLYTEATDGSYIEHKESGMVWHHDEADPDFGSCQAKELLDHLENVLANEPVVVKRGQHIVEVNPQGISKGVVVDSLLSSMVRTGKPPDFVLCIGDDRSDEDMFESIVCPASSSGGVRLPASSEVFACTVGKKPSMAKYYLDDTVDVVKMLDGLASAPSPPRRPGPAAAVQLRVSFEGSL

SEQ ID NO: 821 - protein, 486 aa, Setaria italica
MGSLGGAAQSKPHAVCLPYPAQGHITPMLNVAKLLHARGFDVTFVNTEYNQARLVRTRGAAAVAGVPGFRFATIPDGLPPSEDDDVTQDIPSLCKSTTETCLGPFRRLLAALNDPATGHPPVTCVVSDVVMGFSIDAAKELGLPYVQLWTASTISFLGYQHYRLLMTRGLAPLKDVEQLTNGFLDTPVEDVPGLRNMRFRDFPSFIRTTDPDEFMVHYVLKETGRSAGASAVIFNTFDELEGEAVAAMESLGLARKVYTLGPLPLLAREDPPTPRSSISLSLWKEQEECLRWLDGRDPGAVVYVNFGSITVMTNEQLVEFAWGLANSGRQFLWIIRRDLVKGDSAVLPPEFLAATADRGLMASWCPQQEVLNHPAVGAFLTHSGWNSTLETICGGVPVISWPFFADQQTNCRYQCSEWGVGMEIDSNVRRDAVASLITELMEGEQGKEMRRKAREWRDKAIEAAKPGGASERNFDDLVRDVLLPKN

SEQ ID NO: 822 - protein, 484 aa, Zea mays
MGSLGSAAQQQPQQPHAVCLPYPAQGHITPMLNVAKLLHARGFHVTFVNTEYNQARLVRTRGAAAVAGLPGFRFATIPDGLPPSEDDDVTQDIPSLCKSTTETCLGPFRRLLADLSDPPVTCVVSDVVMGFSIDATKELGLPYVQLWTASTISFLGYRHYHLLKSRGLAPLKSVEQLTNGFLDTAVEDVPGLRNMRFRDFPSFIRSTDPDEYMVGYVLQETGRTAGASAVILNTFDELEGEAVAAMRSLGLARKVYTLGPLPLLAREDPPTPRSAISLSLWKEEEECLRWLDGRDPGSVVYVNFGSITVMTSEQLVEFAWGLANSGRPFLWIIRRDLVRGDTAVLPPEFLSETAGRGLMATWCPQQAVLDHPAVAAFLTHSGWNSTLEAMCGGVPVISWPFFADQQTNCRYQCNEWGVGMEIDSNVRRDAVASLIAELMEGEQGKEMRRRALEWRDKAIEVAKPGGTSHRNFDDLVRNVLLPKN

SEQ ID NO: 823 - protein, 487 aa, Panicum virgatum
MGSLGGGAQGDSRPHAVCLPYPAQGHITPMLNVAKLLHARGFHVTFVNTEYNHARLVRTRGAAAVAGVPGFRFATIPDGLPPSEDDDVTQDIPSLCKSTTETCLGPFRRLLAELNDDPAHPPVTCVVSDVVMGFSIDAAKELGLPYVQLWTASTISFLGYQHYRLLMSRGLAPLKDAEQLTNGFLDTAVDDVPGLRSMRFRDFPSFIRTTDPDEFMVHYVLKETGRSAGASAVIVNTFGELEGEAVAAMESLGLARKVYTLGPLPLLAREDPPTPRSSISLSLWKEQAECLRWLDGREPGAVVYVNFGSITVMTNEQLVEFAWGLANSGRQFLWIIRRDLVKGDSAVLPPEFLAATADRGLMASWCPQQEVLDHPAVGAFLTHSGWNSTLEAMCGGVPVISWPFFADQQTNCRYQCNEWGVGMEIDANVRRDAVAGLITELMEGEQGKEMRRKAREWRDKAIEAAKPGGASHRNLDELVRDVLLPKN

SEQ ID NO: 824 - protein, 490 aa, Panicum virgatum
MGSLGGAAQASSRPHAVCLPYPAQGHITPMLNVAKLLHAKGFHVTFVNTEYNHARLVRTRGAAAVASVPGFRFATIPDGLPPSEDGDVTQDIPSLCRSTTETCLGPFRRLLAELNDVPAAAGHPPVTCVVSDVVMGFSIDAAKELGLPYVQLWTASAISFLGYQHYRLLMSRGLAPLKDAEQLTNGFLDTPVDDVPGLRSMRFRDFPSFIRTTDPDEFMVHYVLKETGRSAGASAVIINTFDELEGEAVAAMESLGLARKVYTLGPLPLLAREDPPTPRSSIRLSLWKEQEECLRWLDGREPGAVVYVNFGSITVMTNEQLVEFAWGLANSGRQFLWIIRRDLVKGDSAVLPPEFLAATADRGLMASWCPQQEVLDHPAVGAFLTHSGWNSTLEAMCGGVPVISWPFFADQQTNCRYQCKVWGVGMEIDANVRRDAVSGLITELMEGEQGKEMRRKALEWRDKAIEAAKPGGASRRNFDELVRDVLLPKN

SEQ ID NO: 825 - protein, 487 aa, Panicum virgatum
MGSLGGGAQGDSRPHAVCLPYPAQGHITPMLNVAKLLHARGFHVTFVNTEYNHARLVRTRGAAAVAGVPGFRFATIPDGLPPSEDDDVTQDIPSLCKSTTETCLGPFRRLLAELNDDPAHPPVTCVVSDVVMGFSIDAAKELGLPYVQLWTASTISFLGYQHYRLLMSRGLAPLKGKSINQSINGFLDTAVDDVPGLRSMRFRDFPSFIRTTDPDEFMVHYVLKETGRSAGASAVIVNTFGELEGEAVAAMESLGLARKVYTLGPLPLLAREDPPTPRSSISLSLWKEQAECLRWLDGREPGAVVYVNFGSITVMTNEQLVEFAWGLANSGRQFLWIIRRDLVKGDSAVLPPEFLAATADRGLMASWCPQQEVLDHPAVGAFLTHSGWNSTLEAMCGGVPVISWPFFADQQTNCRYQCNEWGVGMEIDANVRRDAVAGLITELMEGEQGKEMRRKAREWRDKAIEAAKPGGASHRNLDELVRDVLLP

SEQ ID NO: 826 - protein, 449 aa, Pennisetum glaucum
RGFDVTFVNTEYNQARLLRTRGAAAVAGVPGFRFATIPDGLPPSDDDDVTQDIPSLCKSTTETCLGPFRRLLAALNDPATGHPPVTCVISDVVMGFSIDAAQELGLPYVQLWTASAISFLGYQHYRLLMARGLAPLKDVEQLTNGFLDTPVDDVPGLRNMRFRDFPSFIRTTDPDEYMVHYVLKETGRSAGASAVIINTFDELEGEAVAAMESIGMARKVYTLGPLPLLAREDPPTPRSSITLSLWKEQEECLRWLDGRDPGAVVYVNFGSITVMTNEQLVEFAWGLANSGRQFLWIIRRDLVKGDTAVLPPEFLAATADRGLMASWCPQQEVLNHPAVGAFLTHSGWNSTLETICGGVPVISWPFFADQQTNCRYQCSVWGVGMEIDSNVRRDAVASLITELMDGEQGKEMRRKAREWRNKAIEAAKPGGASHRNFDDLVRDVLLPKN

SEQ ID NO: 827 - protein, 485 aa, Oryza sativa
MGSLGAAGKPHAVCMPYPAQGHITPMLNVAKLLHARGFDVTFVNTEYNHARLVRTRGEAAVAGAPGFRFATIPDGLPPSDDDDVTQDIPSLCRSTKETCLAPFRRLLAQLNDPATGHPPVTCVVSDVVMGFSMAAAKELGLPYVQLWTASSISYLGYRHYRLLMERGLAPLKDVDQLTNGYLDTPVEDVPGLRNMRIKDFPSFIHTTNPEEYMVGYVIEETERCKDASAIIVNSFGDLEGEAVAAMEALGLPKVYTLGPLPLVARKDPPSPRRSSIRLSLWKEQEECLQWLDGKEAGSVVYVNFGSITVMTNEQLVEFAWGLANSGREFLWIVRRDLVKGDTAVLPPEFLAETAERGLMASWCPQQDVLNHPAVGAFLTHSGWNSTLESLAAGVPVISWPFFADQQTNCRYQCNEWGVGMEIDSNVKRGAVACLIAELMEGQKGKEMRRKAEEWREKAIRAAKPGGSSHRNFEELVRHVLLAKES

SEQ ID NO: 828 - protein, 484 aa, Triticum aestivum
MGSMGPAAGKPHAVCLPYPAQGHITPMLNVAKLLHARGFDVTFVNTEYNHARLVRSRGPAAVAGLPGFRFATIPDGLPPSDDDDVTQDIPALCKSTTETCLGPFRDLLARLNDPATGHPPVTCVVSDVVMGFSMEAANELGLPYVQLWTASAISYLGYRHYRLLISRGLVPLKDAEQLANGYLDTPVEEVPGLRSMRLRDFPSFIRTTDPDEYMVHYVLRETERTAGASAVILNSFADLEGESVEAMEALGLPKVYTLGPLPLLAREEPPTPRSAINLSLWKEQEECLQWLEGREPGSVVYVNFGSITVMTSAQMVEFAWGLAQSGKQFMWIVRRDLVRGDAAVLPEEFLAETAGRGLMASWCPQPEVLDHPAVGAFLTHSGWNSALESLCGGVPVISWPFFADQQTNCRYQCNEWGVGMEIDSNVRRDAVAGLITEIMEGEKGKGMRKRAAQWKDSAVKAAMPGGSSHRNFDGLVRDVLLPKN

SEQ ID NO: 829 - protein, 482 aa, Lolium multiflorum
MGSMGAAEKPHAVCLPYPAQGHITPMLNVAKLLHARGFHVTFVNTEYNQARLVRSRGPAALAGVPGFRFATIPDGLPQSDDDDVTQDIPALCKSTTETCLGPFRRVLAELNADTAHPPVTCVISDVVMGFSMEAAKELGLTYVQLWTASAISYLGYRHYRLLMKRGLAPLKDVEQLTNGYLDTPVDDVPGLRGMRLRDFPTFFRTTDPDEYMVHYVLRETERTAGASAVILNSLDELEGEAVAAMEALGLPKVYALGPLPLLAREDPPTARSAINLSLWKEQDECLEWLDGRAPGSVVYVNFGSITVMTNAQMVEFAWGLAQSGRQFVWVVRRDLVKGDAAVLPEEFLAETAGRGLMPSWCPQQEVLDHPAVGAFLTHSGWNSTMESLCGGVPVISWPFFADQQTNCRYQCQQWGVGMEIDSNVRRDAVAGLITEIMEGEKGKGMRKRAVDWKECARKAAMPGGSSHGNFDELVRDVLLPKN

SEQ ID NO: 830 - protein, 484 aa, Triticum aestivum
MGSMGPAAEKPHAVCLPYPAQGHITPMLNVAKLLHARGFDVTFVNTEYNHARLVRSRGLAAVAGLPGFRFATIPDGLPPSDDDDVTQDIPALCKSTTETCLGPFRSLLARLNDPAAGQPPVNCVVSDVVMGFSMEAANELGLTYVQLWTASAISYLGYRHYRLLIGRGIVPLKDAEQLTNGYLDTPVEDVPGLRSMRLRDFPSFIRTTDPDEYIVHYVLRETERTAGASAVILNSFADLEGEAVDAMKALGLAKVYTLGPLPLLAREEPPTPRSAINLSLWKEQEECLQWLEGREPGSVVYVNFGSITVMTSAQMVEFAWGLAQSRKQFLWIVRRDLVRGDAAVLPEEFLAETVGRGLMASWCPQQEVLDHPAVGAFLTHSGWNSALESLCGGVPVISWPFFADQQTNCRYQCNEWGVGMEINNNVRRDAVAGLITEIMEGKKGKGMRKRAAEWKESAVKAAMPGGSSHRNFDGLVRDVLLPKN

SEQ ID NO: 831 - protein, 1240 aa, Setaria italica
MDAAGGRDGEEKKEEKKGNGGGAAAADKRVSFTGLFRYADGTDVLLMLLGTVGALGNGVTQPIMTVIFGQVIDGFGGAVALDDVLHRVNKAVLNFVYLGIATAVVSFLQVSCWTMTGERQATRIRSLYLKSVLRQEIAFFDVEMTTGQVVSRMSGDTVLVQDAIGEKVGKFQQLIATFIGGFVVAFVKGWLLSLVMLACIPPVVLAGGMVSKMLSKISSKGQTSYGEAGNVVEQTLGAIKTVVSFNGEKQAIAAYNKLIHKAYKAAVEEGITNGFGMGSVFCIFFSSYGLAIWSLGNATPCMAAFAEGRSAAYRLFATIKRKPEIDPDDPSGKQLEDIKGDVDLKDVYFSYPARPDQLIFDGFSLHVSSGTTMAIVGESGSGKSTVISLVERFYDPQAGEVLIDGINIKSLRLDWIRGKIGLVNQEPLLFMTSIKDNISYGKEDATIEEIKRAAELANAANFIDKLPNGYDTMVGQRGAQLSGGQKQRIAIARAIIKDPRILLLDEATSALDVESERIVQEALNRIMVNRTTIVVAHRLSTVRNADCISVVQQGKIVEQGPHDELIMNPDGAYSQLIRLQESQEEEEQKLERRMSDKRSKSRSLSLKRSIGRGSAGNSSRHSSTVPFGMPGSVELLEENDTNGENQKEQADDSEAPKKAPMGRLAALNKPEVPILLLGALAAGVHGVLFPMFGLLISNAIKTFYEPPDKLRKDSSFWGLMCVVLGIVSIISVPVEFFLFGVAGGKLIERIRALSFRSIVHQEVAWFDDPKNSSGALGAKLSVDALNVRRLVGDNLALLAQVTSSLITGLVIAFVADWKLTLIILCAMPLSGAQGYAQVKFLKGFSQDAKMLYEDASQVATDAISSIRTVASFCAEKRVMAIYDHKCEASKNQGVRTGMVGGLGFGFSFMMMYLTYGLCFYVGGQFVRHNKSTFADVFKVFFALMLATIGISQTSALASDSTKAKDSSVSIFALLDRKSKVDSSSDEGLTLDEVKGDIDFRHVSFKYPSRPDVQIFSDFTLHIPSGKTVALVGESGSGKSTVISLLERFYNPDSGTISLDGVEIKSLKVDWLRDQIGLVGQEPVLFNDTIRANIAYGKHGEVTEEELLKVAKAANAHEFISSLPQGYDTTVGERGVQLSGGQKQRVAIARAILKDPKILLLDEATSALDAESERIVQDALDNVMVGRTTVIVAHRLSTIKSADIIAVLKDGVIVEKGRHETLMNIKDGFYASLVELRSASS

SEQ ID NO: 832 - protein, 1272 aa, Panicum virgatum
MDAAAAPGGRDGEEKKEGAEKKGSGGGDAGVKRVSFTGLFRYADGTDVLLMLLGTVGALANGVTQPIMTVIFGQVINAFGGAVAVDDVLQRVNKAVLNFVYLGIATAIVSFLQVSCWTMTGERQATRIRSLYLKSVLRQEIAFFDVEMTTGQIVSRMSGDTVLVQDAIGEKVGKFQQLIATFVGGFVIAFVKGWILSLVMLACIPPIVVAGGVVSKMLSRISSKGQTSYDDAGNVVEQTLGNIKTVVSFNGEKQAIATYNKLIHKAYKAAVEEGITNGFGMGSVFFIFFSSYGLAIWCGGKLILSRGYSGGDVINILFAIMIGAASLGNATPCMAAFAEGQSAAYRLFATIKRKPEIDPDDPTGKQLEDVKGDVDLKNVYFSYPARPEQLIFDGFSLHVSSGTTMAIVGESGSGKSTVISLVERFYDPQAGEVLIDGINIKSLRLDWIRGKIGLVNQEPLLFMTSIKDNISYGNDDATIEDIKRAAQLANAANFIDKLPNGYDTMVGQRGAQLSGGQKQRIAIARAIIKDPRILLLDEATSALDVESERIVQEALNRIMVNKTTLVVAHRLSTVWNADCISVVQQGKIVEQGPHDELIMNSDGAYSQLIRLQESQEEEDKKLDQRMSDPRSKSRSLSLKRSISRGSLGNSSRHSLSLPFGMPGSVELLEGNDANRGNQKEQADDSEPPKKAPMGRLAGLNKPELPILLLGALAAGVHGTLFPMFGLMLSNAIKTFYESPHELRKHSSFWGSMCVVLGIISIVSVPVEYFLFGVAGGKLIERIRALSFRSIVHQEVAWFDDPKNSSGALGAKLSVDALNVRQLVGDNLALLTQVTSTLITGFVIAFVADWKLTLIILCAMPLSGAQGYAQVKFLKGFSQDAKMLYEDANQVATDAISSIRTVASFCAKKRVMTIYDHKCEASKNQGVRTGMVGGLGFGFSYMMMYLTYGLCFYVGGQFIRHNKSSFGDIFKVFFALMMATIGISQTSALASDSTKAMDSSISIFALLDRKSKIDSSSDEGLTLDEVMGDIDFQHVSFKYPSRPDVQIFSDFTLRVPSGKTVALVGESGSGKSTVISLLERFYNPDSGTISLDGVEIKSLKVNWLRDQMGLVGQEPVLFNDTIRANIAYGKHGEIIEEELIKVAKAANAHEFISSLPQGYDTTVGERGVQLSGGQKQRVAIARAILKDPRILLLDEATSALDTESERIVQDALDNAVIGRTTIIVAHRLSTIKSADIIAVLKDGVIVEKGRHDTLMNIEDGFYASLVELRSASS

SEQ ID NO: 833 - protein, 1274 aa, Oryza sativa
MDAAANGGRDGKEKKAKNGRDGEDKKKEEDGDAGKKVSFTGLFRYADGTDLLLMAVGTVAALANGVSQPLMTVIFGQVINAFGEATNGDVLHRVNQAVLNFVYLGIATAVVSFLQVACWTMTGERQATRIRSLYLKSVLRQDIAFFDVEMTTGQIVSRMSGDTVLVQDAIGEKVGKFLQLVATFAGGFVVAFVKGWLLSLVMLACIPPVVIAGGAVSKMLAKISSKGQASYSDAANVVEQTIGAIKTVVSFNGEKQAVASYNKLINKAYKAAVEEGLTNGFGMGSVFFIFFSSYGLAIWYGGKLVVSKGYSGGDIINILFAVMTGAMSLGNATPCMAAFAEGQSAAYRLFKTIKRKPQIDPDDITGKQLEDIRGDVELKDVYFSYPARPEQLIFDGFSLHVSSGTTMAIVGESGSGKSTVISLVERFYDPQAGEVLIDGINIKSLRLNWIRGKIGLVSQEPLLFMTSIKDNITYGKEDATIEEIRRAAELANAANFIDKLPDGYDTMVGQRGAQLSGGQKQRIAIARAILKNPKILLLDEATSALDVESERIVQEALNRIMVDRTTLVVAHRLTTVRNADCISVVQQGKIVEQGPHDELVMNPNGVYSQLIRLQETHEEEEKKLDHHISDSRSKSRSLSFKRSISRDSAGNSSRHSLALPFGLPGSVELLEGNDSTVGEQTEQGGDGEVQQKAPIGRLARLNKPEVPILLLATLAAGVHGVLFPMFGVMISNAIKTFFEPADKLKKDASFWGLMCVVLGIISIISIPVEYFMFGIAGGKLVERVRALSFRSIIHQEVAWFDDPRNSSGALGARLSVDALNVRRLVGDNLALAVQVVSTLITGIVIAMIADWKLTLIILCVIPLVGLQGYAQVKFLKGFSEDAKMLYEDASQVATDAVSSIRTVASFCSEKRVMTMYDNKCEASKNQGVRTGMVGGLGFGFSFLMLYLTYGLCFYVGAQFVRHNKTTFGDVFKVFFALVLATIGISQTSAMASDSTKAKDSAISIFALLDRKSQIDSSSDEGRTLANVKGNIDFRHVSFKYPTRPDVQIFSDFTLHIPSGKTVALVGESGSGKSTAIALLERFYNPESGTILLDEVEIKNLKVNWLRDQMGLVGQEPVLFNDTIRANIAYGKHGDVTEEELIKAAKASNAHEFISSLPQGYDTTVGERGVQLSGGQKQRVAIARAILKDPKILLLDEATSALDAESERIVQDALDNVMVGRTTIIVAHRLSTIKGADIIAVLKDGAIAEKGRHEALMNIKDGVYASLVELRSGSS

SEQ ID NO: 834 - protein, 1256 aa, Aegilops tauschii
MDAAAKGRDGEEKKEGGHGKRVSFTGMFRYADRTDQLLMLVGTLAALANGVSQPLMTVIFGDMIDAFGGATSDNVLHRVNKAVLSFVYLGIGTAVVSFLQVACWTITGERQATRVRSLYLKSVLRQDISFFDVEMTTGQIVSRMSGDTVLVQDAIGEKVGKFLQLVATFIGGFVVAFVKGWLLSLVMLACIPPVVIAGGAVAKVLSTISSKGQESYSDAANVVEQTIGSIKTVASFNGEKQAIGDYNKLINKAYKTTVKEGLANGFGMGSVFFIFFSSYGLAIWYGGKLILTKGYTGGEVISILFAIMTGAMSLGNATPCMTAFAEGQSAAHRLFTTIKRKPEIDPDDKTGRQLEDIKGDVELRDVYFSYPARPEQLIFDGFSLHVSSGTTMAIVGESGSGKSTVISLVERFYDPQAGEVLIDGINIKSLQLDSVRGKIGLVSQEPLLFMTSIKDNITYGKEGATIEEIKRAAELSNAANFIDKLPNGYDTMVGQRGAQLSGGQKQRIAIARAIIKNPKILLLDEATSALDVESERIVQEALNRIMVDRTTLVVAHRLTTVRNADCISVVQQGKIVEQGPHDELVVNPDGAYSQLIRLQEHNEEEQKVDHRRLDPRSKSTSLSLKRSISRGSAGNSSRNSFNLSFGLPGAVELPEGNDTHGENHTEQDGEVPKKAPMGRLALLNKPEVLIILLGSLAAAVHGVLFPMFGVMISSAIKTFYEPPDKLRKDSSFWGLMCVVLGIISIISIPAELFLFGIAGGKLIERIRAMSFRSIVHQEVAWFDDPKNSSGALGARLSVDALNVRRLVGDNLALTVQIISTLITGFVIAMIADWKLSLIILCVIPLVGLQGYAQVKFLKGFSQDAKMMYEDASQVATDAISSIRTVASFCSEKRITRIYDDKCEASMSQGVRTGVVGGIGFGFSFLMLYLTYGLCFYVGAQFVRHGQSSFGDVFKVFFALVLATIGVSQTSAMATDSTKAKDSAISIFALLDRKSEIDSSRNEGLTLDEVKGNIDFQHVSFKYPTRPDIQIFSDFTLHIPSGKTVALVGESGSGKSTVIGLLERFYNPDSGTISLDGVEIKSLNINWLRDQTGLVSQEPVLFNDTIRANIAYGKDGEVTEEELIAAAKASNAHEFISSLPQGYDTTVGERGIQLSGGQKQRVAIARAILKDPKILLLDEATSALDAESERIVQDALDNVMVGRTTVVVAHRLSTIKGADIIAVLKDGAIVEKGRHEVLMNIKDGVYASLVELRSASS

SEQ ID NO: 835 - protein, 1262 aa, Brachypodium distachyon
MDAAAKGRDGEEQAVESGAEHGKKVSFAGLFRYADGTDLLLMLVGTVAALANGVSQPLMTVIFGDVIDAFGGATTANVLSRVNKAVLSFVYLGIGTAVVSFLQVSCWTITGERQATRIRSLYLKSVLRQDISFFDVEMTTGKIVSRMSGDTVLVQDAIGEKVGKFLQLVASFLGGFIVAFVKGWLLALVMLACIPPVVIAGGAVSKVLSKISSKGQTSYSDAGNVVEQTIGAIKTVVSFNGEKQAIATYNKHIHKAYKTAVEEGLTNGFGMGSVFFIFFSSYGLAIWYGGKLVLSKGYTGGQVITILMAIMTGAMSLGNATPCMTAFAGGQSAAYRLFTTIKRKPEIDPDDKTGKQLEDIRGEVELKDVYFSYPARPEQLIFDGFSLRVASGTTMAIVGESGSGKSTVISLVERFYDPQAGEVLIDGINIKSLRLDSIRGKIGLVSQEPLLFMTSIKDNITYGKENATIEEIKRAAELANAANFIDKLPNGYDTMVGQRGAQLSGGQKQRIAITRAIIKNPKILLLDEATSALDVESERIVQEALNRIMVDRTTLVVAHRLTTVRNADCISVVQQGKIVEQGSHDELVVNPDGAYSQLIRLQESRAEEEQKVDRRISDPRSKSTSLSLKGSISRNSSGNSSRHSFTLPFGLPGTVELTETNDTYGKNQNEQDNDCEIPKKAPMGRLALLNKPEVPILLLGSIAAGVHGVLFPLFGVMISSAIKTFYEPPEKLKKDSSFWGLMCVVLGVVSIISIPVEMFLFGIAGGKLIERIRALSFRSIIHQEVAWFDDPKNSSGALGARLSVDALNVRRLVGDNLALTVQIISTLITGFIIAVVADWKLSFIILCVIPLVGLQGYAQVKFLKGFSQDAKMMHEDASQVATDAVSSIRTVASFCSEKRITSIYDQKCEASMNQGVRTGIVGGIGFGFSFLMLYLTYGLCFYVGAQFVRHGKSNFGDVFQVFFALVLATVGVSQTSAMATDSTKAKDSAISIFALLDRKSEIDSSSNEGLTLDEVKGNIDFQHVSFKYPTRPDIQIFSDFTLHIPSGKTVALVGESGSGKSTVIALLERFYNPDSGTISLDGVEIKSLNINWLRDQTGLVSQEPVLFNDTIRANIAYGKDGELTEEELIAAAKASNAHEFISSLPQGYDTTVGERGIQLSGGQKQRVAIARAILKDPKILLLDEATSALDAESERIVQAALDHVMVGRTTVVVAHRLSTIKNADIIAVLKDGAIVEKGRHEALMNIKDGMYASLVELRSSSS

SEQ ID NO: 836 - protein, 1260 aa, Secale cereale
MDAAAAAKGKDGHGEEKKEGGHGKRVSFTGMFRYADRTDLLLMLVGTLAALGNGVSQPLMTLIFGDLIDAFGGATSDNVLHRVNKAVLSFVYLGIGTAVVSFLQVACWTITGERQATRIRSLYLKSVLRQDISFFDVEMTTGQIVSRMSGDTVLVQDAIGEKVGKFLQLVATFIGGFVVAFVKGWLLSLVMLACIPPVVIAGGAVAKVLSTISSKGQASYSDAANVVEQTIGSIKTVASFNGEKQAIGEYNKLINKAYKTTVKEGLANGFGMGSVFFIFFSSYGLAIWYGGKLILTKGYTGGEVISILFAIMTGAMSLGNATPCMTAFAEGQSAAHRLFTTIKRKPEIDPDDKTGKKLEDIKGDVELRDVYFSYPARPEQLIFDGFSLHVSSGTTMAIVGESGSGKSTVISLVERFYDPQAGEVLIDGINIKSLQLDSVRGKIGLVSQEPLLFMTSIKDNITYGKEGATIEEIKRAAELANAANFIDKLPNGYDTMVGQRGAQLSGGQKQRIAIARAIIKNPKILLLDEATSALDVESERIVQEALNRIMVDRTTLVVAHRLTTVRNADCISVVQQGKIVEQGPHDELVVNPDGAYSQLIRLQENNEEDQKVDHRRLDPRSKSTSLSLKRSISRGSAGNSSRNSFNLSFGLPGAVELPEGNDTHGENHTEQDVEVPKKAPMGRLALLNKPEVLIILLGSLAAAVHGVLFPMFGVMISSAIKTFYEPPDKLRKDSSFWGLMCVVLGIISIISIPAELFLFGIAGGKLIERIRAMSFRSIVHQEVAWFDDPKNSSGALGARLSVDALNVRRLVGDNLALTVQIISTLITGFVIAMIADWKLSLIIICVIPLVGLQGYAQVKFLKGFSQDAKMMYEDASQVATDAISSIRTVASFCSEKRITRIYDDKCEASMSQGVRTGIVGGIGFGFSFLMLYLTYGLCFYVGAQFVRHGQSTFGDVFKVFFALVLATIGVSQTSAMATDSTKAKDSAISIFALLDRKSEIDSSRNEGLTLDEVKGNIDFQHVSFKYPTRPDIQIFSDFTLHIPSGKTVALVGESGSGKSTVIGLLERFYNPDSGTISLDGVEIKSLNINWLRDQTGLVSQEPVLFNDTIRANIAYGKDGEVTEEELIAAAKASNAHEFISSLPQGYDTTVGERGIQLSGGQKQRVAIARAILKDPKILLLDEATSALDAESERIVQDALDHVMVGRTTVVVAHRLSTIKGADIIAVLKDGAIVEKGRHEVLMNIKDGVYASLVELRSAAS

SEQ ID NO: 837 - protein, 1165 aa, Panicum virgatum
CIVCAEVSCWTMTGERQATRIRSLYLKSVLRQEIAFFDVEMTTGQVVSRMSGDTVLVQDAIGEKVGKFQQLIATFIGGFVVAFVKGWLLSLVMLASIPPIVIAGGFVSKMLSRISSKGQTSYGDAGNVVEQTLGNIKTVVSFNGEKQAIATYNKLIHKAYKAAVEEGITNGFGMGSVFFIFFSSYGLAIWYGGKLILSRDYSGGDVINILFAIMTGAMSLGNATPCMAAFAEGQSAAYRLFATIKRKPEIDPDDPTGKQLEDIKGDVDLKDVYFSYPARPEQLIFDGFSLHVSSGTTMAIVGESGSGKSTVISLVERFYDPQAGEVLIDGINIKSLRLDWIRGKIGLVSQEPLLFMTSIKDNISYGKEDATIEDIKRAAELANAANFIDKLPNGYDTMVGQRGAQLSGGQKQRIAIARAIIKDPRILLLDEATSALDVESERIVQEALNRIMVNRTTLVVAHRLSTVRNADCISVVQQGKIVEQGPHDELIMNSDGAYSQLIRLQESQEEEVQKLDRHMSDPRSKSRSLSLKRSISRVSAGNSSRHSLTLPFGMPGSVELLEGNDANRENQKEQVNDREAPKKAPMGRLAGLNKPELPILLLGALAAGVHGVLFPMFGLLLSNAIKTFYEPPHELRKHSSFWGLMCVVLGITSIVSVPMEYFLFGVAGGKLIERIRALSFQSIVHQEVAWFDDPKNSSGALGAKLSVDALNVRRLVGDNLALLAQVTSTLITGFVIAFVADWKLTLIILCAMPLSGAQGYAQIKFLKGFSQDAKMLYEDASQVATDAISSIRTVASFCAEKRVMTIYDHKCEASKNQGVRTGMVGGLGFGFSFMMMYLTYGLCFYVGGQFVRHNKSSFGDVFKVFFALMMATIGISQTSALASDSTKAKDSSISIFALLDRKSKIDSGSDEGLTLDEVKGDIDFRHVSFKYPSRPDVQIFSDFTLHIPSGKTVALVGESGSGKSTVVSLLERFYNPDSGAISLDGVEIKSLKVNWIRDQMGLVGQEPVLFNDTIRANIAYGKHKVVTEEEIIKVAKAANAHEFISSLPQGYDTTVGERGVQLSGGQKQRVAIARAILKDPRILLLDEATSALDAESERIVQDALDNVMVGRTTIIVAHRLSTIKSADTIAVLKDGVIVEKGRHETLMNIKDGFYASLVELRSASS

SEQ ID NO: 838 - protein, 1237 aa, Setaria italica
MADAAAVTAAKGLEEKKKEKGGGGDAGKMVPFVGLFGYADGKDVLLMLVGTVAALGNGFAQPLMTLIFGQLINAFGGATTETILDRVIKVVLNFVYLGTGTGVAAFLQVSCWTMTGERQATRIRSLYLKSVLKQDVAFFDVELTTGQAVSRMSGDTVIVQDAIGEKVGKFLQLTSNFIGGFIVAFVKGWLLSLVMLSCIPPVVIAGGVVSKMLSKISSKGQASYSDAGNVVEQTIGAIKTVISFNGEKQAIALYNKFTHKAYKATVEEGITNGFGRGSVFFVFFASYGLAIWSLGHATPCIAAFAAGQSAAYRLFTTIKRKPEIDPDDASGKELEDIRGDVELKDVYFSYPARPEQLIFDGFSLHVPNGTTMAIVGESGSGKSTVISLVERFYDPQAGEVLVDGINIKSLRLGWIRGKIGLVSQEPLLFMASVKDNIRYGKEDATIEEIKRAAELANAANFIDKFPNGYDTSVGQRGAQLSGGQKQRIAIARAIIKNPKILLLDEATSALDVESERTVQEALNRIMVDRTTLVVAHRLSTVRNADCISVVQKGKIVEQGHHDELVINPDGAYSQLIRLQKSPKDKQKLDCRIYDTMSKSRRLTSIELIGRSSAGNSSRHSFILPFGLPSSVELLEGNDTNENLKEEAGDSGIPKQTHLGRLANLNKPELPFILLGSLAAAVHGMLLPVSGIIISNAIIIFFEPADKLRKDSQFWGLLGVVLGIVSIIAVPLEYFLFGVTGGKLIERIRALSFRSIVHQDVAWFDDPKNSSGTLSARLSVDALNVRRLVGDSLALAVEVTSTLITGFVIAMIADWKLCLIIICVIPLVGLQGYAQIKFLKGFSEDAKLLYEDASQMATDAVSSIRTVASFCSEKRVMTIYNHKCEASKNQGVRTGMIAGLGFGISYLLLNLTYGLCFYVGAQFIHHDKSTFSAVFKVFFALMLATFGISETSALASDSKKAKESTVSIFALLDRKSKIDSGSNEGLTLDEVKGDIDFRHVSFKYPSRPDVQIFSSFTLHIPTGKTVALVGESGSGKSTVIALLEQFYRPDSGTISLDGVEIKNLKINWLRNQMGLVSQEPVLFNDTIRANIAYGKQGEVTEEELIKVAKLADAHEFISSLPQGYQTTVGERGVQLSGGQKQRVAIARAILKDPRILLLDEATSALDAESERIVQDALDHVMVGRTTVIVAHRLSTIKGADIIAVLKDGMIVEKGSHETLMNIKDGFYTSLVELRSSSP

SEQ ID NO: 839 - protein, 1154 aa, Setaria italica
MTGERQATRIRSLYLKSVLRQEIAFFDVEMTTGQLVSRMSGDTVLVQDAIGEKVGKFQQHIATFIGGFVIAFIKGWLLSLVMLACIPPVVVAGGMVSKMLFKISSKGQTSYGEAGNVVEQTLGAIKTVVSFNGEKQAIAAYNKLIHKAYKAAVEEGITNGFGMGSVFCIFFSSYGLAIWYGGKLILSKGYSGGDVINILLAIITGAMSLGNATPCLAAFAEGRSAAYRLFATIKRKPEIDPDDPSGKQLEDIKGDVDLKDVYFSYPARPDQLIFDGFSLHVSSGTTMAIVGESGSGKSTVISLVERFYDPQAGEVLIDGINIKSLRLDWIRGKIGLVNQEPLLFMTSIKDNISYGKEDATIEEIKGAAELANAANFIDKLPNGYDTMVGQRGAQLSGGQKQRIAIARAIIKDPRILLLDEATSALDVESERIVQEALNRIMVNRTTIVVAHRLSTVRNADCISVVQQGKIVEQGPHDELIMNPDGAYSQLIRLQESQEEEEQKLERRMSDKRSKSRSLSLKRSIGRGSAGNSSRHSSTVPFGMPGSVGLLEDNDTNGENQKEQADDSEAPKKAPMGRLAALNKPEVPILLLGALAAGVHGVLFPMFGLLISNAIKTFYEPPDKLRKDSSFWGLMCVVLGIVSIISVPVEFFLFGVAGGKLIERIRALSFRSIVHQEVAWFDDPKNSSGALGAKLSVDALNVRRLVGDNLALLAQVTSSLITGLVIAFVADWKLTLIILCAMPLSGAQGYAQVKFLKGFSQDAKMLYEDASQVATDAISSIRTVASFCAEKRVMAIYDHKCEASKNQGVRTGMVGGLGFGFSFMMMYLTYGLCFYVGGQFVRHNKSTFADVFKVFFALMLATIGISQTSALASDSTKAKDSSVSIFALLDRKSKVDSSSDEGLTLDEVKGDIDFRHVSFKYPSRPDVQIFSDFTLHIPSGKTVALVGESGSGKSTVISLLERFYNPDSGTISLDGVEIKSLKVDWLRDQIGLVGQEPVLFNDTIRANIAYGKHGEVTEEELLKVAKAANAHEFISSLPQGYDTTVGERGVQLSGGQKQRVAIARAILKDPKILLLDEATSALDAESERIVQDALDNVMVGRTTVIVAHRLSTIKSADIIAVLKDGVIVEKGRHETLMNIKDGFYASLVELRSASS

SEQ ID NO: 840 - protein, 343 aa, Zea mays
MAAAACNPVAPSGPVPFKDVDDGSVPEHTPKEEFGDLVAALPSRQQSILELRLYQGFWLPEHWVPGTIVFQRRFTPRPDDVILASYPKCGTTWLKALAFATAARTAYPPGGARHPLRRLNPHDCVPFIDEIFASGEEAKLEALPSPRLMNTHLPYALLPAPVTATATGCRVAYVCRDPKDMVVSLWHFLRRAKPDLLFADTFESVCDGTVVAGPVWDHVLSYWRASVAAPDRALFLRYEDMLRDPGGNVRRLAEFMGRPFSAAEEAAGDVAAVVELCSFDEMKGLEVNRPGSGTAGRYRPMPRDAFFRKGVAGDWANHMTPEMAARLDGIFREKLQGTGLIFS

SEQ ID NO: 841 - protein, 351 aa, Setaria italica
MDAAAANTVVPSGPVPFKDVDDGTVPEHTPKEEFGDLVAALPRRQQSILELRLYQGFWLPEHWVPGTVVFQRRFSPRPDDVVLASYPKCGTTWLKALAFAAAARGAYPPAAPGHPLRRLNPHDCVPFIDEIFAGGEEAKLDALPSPRLMNTHLPYTLLPDRVTNAGGCRVVYVCRDPKDMVVSLWHFLRRAKPDLSFVETFESVCDGTVAAGPVWDHVLSYWRPSVARPDRVLFLKYEDLLRDTAANVRRLAEFMGRPFTAAEEAAGDVAAVVELCSFDEMKGLDVNKAGSGTAGRYCAMQRDAFFRKGVAGDWANHMTPEMAARLDGIIREKLQGTGLDFAQGSSRDVDV

SEQ ID NO: 842 - protein, 261 aa, Zea mays
MSTPALATAAEGATRIILVHGTGHGGWCWYRVATLLRAAGHRVDAPDLAASGIDSRQLRDVPTFEDYTRPLLDALRALPPGERAVLVGHSFGGMSIALAAETFPEKVAAAVFVTAFLPDCTNPRSQVIEKVTVSDWMDTVTDAEHVPASVFLGPEFLRHKLYQLSPPEDYTLSQSLARVSSYYVPDLQSQTPFSEARYGAVSKMYVVCKQDQAMTEAYQHTMIAACPVAEVREIADADHMAMFSAPAELAGHLAHVANTYA

SEQ ID NO: 843 - protein, 263 aa, Setaria italica
MSPPPAIIPTAAEGAARIILVHGTGHGGWCWYRVATLLRAAGHRVDAPDLAASGADARRLRDAPTFEDYTRPLLDLLQALPDGERAVLVGHSFGGMSVALAAEAFPDKVAAAVFVTAFLPDCTNPRSHVIEKLTLTDWMDSVTDAEHDPPSVFLGPEFLREKLYQLSPPEDYTLSQSLARVSSHYVADLRGQPPFSEARYGAVRKVYVVCDQDQAMLEPYQRAMIAGCPVAEVRAIAGADHMAMFSAPAELAGHLADVANTYA

SEQ ID NO: 844 - protein, 398 aa, Hordeum vulgare
MEGVEEIVIAGAGLAGLATALGLHRKGVRSVVLESSATLRASGYAFNTWTNAFRALDALGVGDKIREHHLLYERLVAFSASTGEAAAEVSLKMQGKSGPHEIRCVKRNFLLETLENELPEGTIRYSSKIVAIEEEGSVKLLHMADGSTMRANVLVGCDGVNSVVAKWLGLPKPILSGRSATRGMAEYPDGHGFRPEILQFIGQGFRSGVLPCSDTSVYWNYTWYPSPADGDAEESVAKMRQHVLAKLKAAKIPAEALDVIERSEMSEVVSSPLRFRSPLSLVRGSICRGGVCVAGDAFHPMTPELGQGGCAALEDGVVLARCLGVAFAAGGHGSAEAALAKYAEERRWRAIRLVTAAYVVGFVQQSSNPAIKFLREKFLSGLLARVMVDMADYDCGKL

SEQ ID NO: 845 - protein, 400 aa, Triticum aestivum
MEGVEEIVIAGAGLAGLATALGLHRKGVRCVVLESSATLRASGYAFTTWTNAFRALDALGVGDKIREHHLLYERLVAFSASTGEAAAKVSLKMQGKSGPHEIRCVKRNFLLETLENELPEGTIRYSSKIVAIEIEEEGNVKLLHMADGSTIRANVLVGCDGVNSVVARWLGLPKPILSGRSATRGLAEYPDGHGFGPEMLQFIGQGFRSGVLPCSDTSVYWNYTWYPSPADGDAEESVAKMRRHVLARLTAAKIPAEALDVVERSEMSDVVSSPLRFRSPLALVRGSICRGGVCVAGDAFHPMTPELGQGGCAALEDGVVLARCLGEAFAVGGHGSAEAALEKYAQERRWRAVRLVTAAYVVGFVQQSSNPAIKFLREKFLSGLLARVMVDMADYDCGKL

SEQ ID NO: 846 - protein, 399 aa, Brachypodium distachyon
MEGVEDIVIAGAGLAGLATALGLHRKGVRSVVLESSATLRASGYAFTTWTNAFRALDALGVGDKIREHHLLYERLVAFSASTGEAAAKVSLKMQGKSGPHEIRCVKRNFLLETLESELPEGTIRYSSKIAAIDEEGDVKLLHMADGSIIKAKVLIGCDGVNSVVAKWLGLPKPIQSGRSATRGMAEYPDGHGFGPEMLQFIGQGFRSGVLPCSDTSVYWNYTWYPSPDDKDAEESVAKMRQHVLTKLRAAKIPLEALDVIERSEMSEVVSSPLRFRSPLSLVRGSISRGNVCVAGDAFHPMTPELGQGGCAALEDGVVLARCLGDAFAHGYACESVKAGLEKYADERRGRAIRLVTAAYVVGFVQQSNNTVVKFLREKFLSGLLAKLMVDMADFDCGEL

SEQ ID NO: 847 - protein, 404 aa, Avena sativa
MAAVEDIVIAGAGLAGLATALGLHRKGVRSLVLESSATLRASGYAFTTWTNAFRALDALGVGDKIREHHLLYERLVAFSASTGEAAAKLSLKMQGKSGPHEIRCVKRNFLLETLEKELPEGTIRYSSKIVAIEEEEGNVKLLHMADGSTIRANVLVGCDGVNSVVAKWLGLPKPILSGRSATRGMAEYPDGHGFGPEILQFIGQGFRSGVLPCSDTSVYWNYTWYPSRKDDGDAEESVAKMRQYVLTKLKAAKIPAEALDVIERSEMSDVVSSPLRFRSPLALVRGSISRGNVCVAGDAFHPMTPELGQGGCAALEDGVVLARCLGEAFVGAGNDGGHACVKAALERYAQERRWRAIRLVTAAYVVGFVQQSSNVAIKFLREKFLSGLLARVMVDMADFDCGKL

SEQ ID NO: 848 - protein, 398 aa, Secale cereale
MEGVEEIVIAGAGLAGLATALGLHRKGVRCLVLESSATLRASGYAFTTWTNAFRALDALGVGDKIREHHLLYERLVAFSASTGEAAAKVSLKMQGKSGPHEIRCVQRNFLLETLESELPEGTIRYSSKIVAIEEEGNVKLLHMADGSTIRANVLVGCDGVNSVVARWLGLPKPILSGRSATRGMAEYPDGHGFGPEILQFIGQGFRSGVLPCSDTSVYWNYTWYPSPADGDAEESVGKMRQHVVAKLRAARIPAEALDVVERSEMSEVVSSPLRFRSPLALVRGSICRGGVCVAGDAFHPMTPELGQGGCSALEDGVVLARCLGEALGGGGHGSAEAALEKYAVERRWRAIRLVTAAYVVGLVQQSSNRVIKFLRERFLSGLLARVMVDMADYDCGKL

SEQ ID NO: 849 - protein, 493 aa, Panicum virgatum
MAIEGQQQPLHMLFFPFLVPGHLIPAADMAALFAARGVKCTILTTPVNAAVIRSAVDRANEASRGADGALAIDIAVVPFPDVGLPPGVESGPALNSDADREKFFQALQLLREPFDRFLAENRTDAVVSDSFFDWSADAAAEHGVPRLGFLGTSLFARACSNSTARHNPVEAAPEDPDAPVLLPGLPHRVEMRRSQMMEPKKRPDRWALLQRMNAADQRSYGELFNSFRELEPDYLEHYTTTLGRRAWLVGPVAFASKDVATRGADDEGLSPDADGCLRWLDTKPAGSVAYVSFGTLSRFSPPELRELARGLDQSGKNFVWVVGGGADDAEESEWMPDGFAELLARGERGLIIRGWAPQMLILNHAAVGGFVTHCGWNSTLEAVGAGVPMVTWPRYADQFYNEKLVVELLKVGVGVGSTDYASKLEARRVIGGDVVAEAIERVMGDGEEAQAIRERARVLGEKARRAVEKGGSSYDDVGRLMDELMARRGLVNV

SEQ ID NO: 850 - protein, 479 aa, Zea mays
MAGGDGADEITLEHTPTWIVASVCSIIVVISLLFERLLHRLGKRLAKGRRKPLYEALLKVKEELMLLGFISLLLTVFQGATQKICVRESLMNHLLPCPRTTAKTSAHFVGTRRLLAGGGGVSSDYCLSKGKVPILSVDAIHQLHIFIFVLAVTHVVLSAVTVILGITQTRNWKYWEEKIQQNDDSAPQMIKHVQEFKFIKSHFRGHGKRWGIFGWLRSFFKQFYGSVTEEDYTTLRLGFVMKHCRGHPKFNFYNYMDRAFEGDFKKVVGISWYLWGMLMIFLLLNVHGWYVYIWISVIPFILLLVLGSKMEHIITELALEVIQKHTAIEGVLVVTPSDELFWFHRPKLVLLLIHIILFQNAFEIAFFFWLLVTYGFNSCIMGKPAYVITRVVISVISQVLCGYSTLPLYALISQMGSSFKKAIFDENVSEGLINWAENARRRNRMPTSVGDNSPVGEGIQMSNQTQRESSMEQGTARLI

SEQ ID NO: 851 - protein, 144 aa, Saccharum officinarum
MSKQKTVIRLGVPNAKNRSKAMQLASKFVGVNSVAITGEAKDRLEVVGESVDIPCLINCLRKKVCRADIVLVEEVKDKKKEEEEKKKKEEEAKKKKAEEDKKKAEEELKKLWAACPPPYSGGYYRGPPPTTFVCEEQPAGCHIM

SEQ ID NO: 852 - protein, 1528 aa, Setaria italica
MALPWWLATTACAAPPPGHGSLADLLAFVLLSPCPQRALVGAVDLVFLAACLVLLARRPRSGGGSAVAAAAPPEREALLQKPSHHPSPPPFRYVVSLGASAVLAAASVVLLALAILLLPSTPWRAAEAAFLSVHAVAHGAAAWTVATSRRAGAAQGAHQAHLRVFWLATALGAVLFSASAVVRGADGSLIFPDDVLAFAGLLVSLPLAYVAATGFTGHGTGAGDCEPEHAGEEAPASPYVAASFLSRATFSWIISLINKAYAAESLIADDVPPVPPGLRAEAAHDLFMSNWPASPASRHPVGVALWLSFWPRLVLTAFLGLARLAAMYVGPSLIDQFVEFIRRGGTPWEGLRLVLILLVGKAVQTLASHHYNFQGQLLGMRIRGALQTALYRKSLRLTAGARRAHGAGSIVNYIQVDAGIVSFAMHGLHGLWLMPLQIVVALLLLYTYLGPAVLMTLAVITAVTVITAFANKFNLSYQLKFLGVRDSRVKAITEMLNHMRVIKLQAWEDTFGGKVRDIRRDELGWLAKIMLFMCANTVVFSSGPLAMTVLVFGTYIASGGQLDAGKVFTATAFFRMLEGPMQNFPQTIVMSMQAFVSLGRLNKFLTDAEIDTTAVERVESGGAEDTPVAVEVQGGVFAWDVPASEEMRSSDSQARLGVEENGQGNGSAELVTVLKGIDVEVRRGELTAVVGTVGSGKSSLLSCIMGEMHKVSGKVSIFGSTAYVAQTAWIRNGTIQENILFGKPMHLERYSEIIHACCLEKDLEMMEFGDQTEIGERGINLSGGQKQRIQLARAVYQDCDIYLLDDIFSAVDAHTGSTIFMECLKGMLKNKTVLLVTHQMDFLQNVDTIIVMKDGLVIQSGIYGELLASCPDFSDLVAAHHSSMETTGEQGCHVQNTESSQASTGSVDVPSINSKSNDENGETTGTAINKEAGSSKLIKEEEKESGRVSWRVYKLYMTQAWGWWGVVVILVVTLLSEGSSMASNYWLSYETSGGPVFDTTIFLGVYASIVATTIILEMITTIIVTFLGLQSAQAFFNKMFDSILRAPMSFFDTTPSGRILSRASSDQSKIDTSLVFYVGFATSMCISVVTNIAVTCQVAWPSVIAVLPLLLLNIWYRNRYIATSRELTRLQGVTRAPIIDHFTETFLGAPTVRCFRKEDEFYQTNLDRINSNLRMSFHNYAANEWLGFRLELIGTLILSITAFLMISLPSNFIKKEFVGMSLSYGLSLNSLVYYTISISCMIENDMVAVERVHQYSTLPSEAAWEVADCLPSSNWPSRGDIDVKDLKVRYRQNTPLILKGITVSIKNGEKIGVVGRTGSGKSTLVQALFRIVEPAEGRIIIDGVDICTLGLHDLRSRFGVIPQEPVLFEGTVRSNIDPTGQYSEAEIWQALERCQLKDIVASKPEKLDALVADMGENWSVGQKQLLCFGRVILKRSRILFMDEATASVDSQTDAAIQRIIREEFAECTVISIAHRIPTVMDSDRVLVLDAGLVAEFDAPSKLMGRPSLFGAMVKEYASRSSSSKETDG

SEQ ID NO: 853 - protein, 197 aa, Saccharum officinarum
MCGGAIIADFVPADARRPATDDTISASLLSGEDHLEELPPARLPLPGRKTAYRGIRRRPWGRWAAEIRDPRKGARVWLGTYATPEDAARAYDAAAREIRGPKAKLNFPPAVGAGGAREPAAKRRRKSAAAAEESSGSSPAAATTVVVAGGSGGGGGGETLRDCMSGLEAFLGLQEEAEAADEGGDVEAWDAVDLMFA

SEQ ID NO: 854 - protein, 106 aa, Saccharum officinarum
MADEEKKHHHHLFHRHKDGEEEASTGEVDYEKKEKHHKHLEQLGGLGAIAAGAYAIHEKHKAKKDPENAHGHKVKEEVAAVAAVGAAGFAFHEHHQKKDAKKQGQS

SEQ ID NO: 855 - protein, 106 aa, Zea mays
MAEEKKHHHLFHRHKDGGEEEASAGGEVDYDKKEKHHKHLGQLGGLGAIAAGAYAIHEKHKAKKDPENAHGHKVKEEVAAVAALGAAGFAFHEHHQKKDAKKQGQS

SEQ ID NO: 856 - protein, 106 aa, Triticum aestivum
MAEEKKHHHLFHRHKDGGEEEASAGGEVDYDKKEKHHKHLGQLGGLGAIAAGAYAIHEKHKAKKDPENAHGHKVKEEVAAVAALGAAGFAFHEQHQKKDAKKQGQS

SEQ ID NO: 857 - protein, 107 aa, Setaria italica
MAEEKKHHHLFHRHSKDDGEEEASAGEVDYEKKEKHHKHLEQLGGLGAIAAGAYAIHEKHKAKKDPENAHGHRVKEEAAAVAALGAAGFAFHEHHQKKDAKKHAADN

SEQ ID NO: 858 - protein, 104 aa, Panicum virgatum
MADEKKHHHLFHRHKDGEEEAGEVDYEKKEKHHKHLEQLGGLGAIAAGAYAIHEKHKAKKDPENAHGHKVKEEVAAVAALGAAGFAFHEHHQKKDAKKHAADDN

SEQ ID NO: 859 - protein, 109 aa, Panicum virgatum
MAEEKKHHHHLFHRHKDGEEEGGAAAGEVDYEKKEKNHKHLEQLGGLGAIAAGAYAIHEKHKAKKDPENAHGHKVKEEVAAVAALGAAGFAFHEHHQKKDAKKHAAGDN

SEQ ID NO: 860 - protein, 473 aa, Zea mays
MGSTSATGTTSSSSSAAHGGGAAHVLLLPYPGAQGHTNPLLQFGRCLAYHGLRPTLVTSRYVLSTTPPPGEPFRVAAISDGFDDGGAAACPDLDVYWRQLEAVGSETLAELIRSEAADGRPVRVLVYDPHLPWARRVAQAAGLAAAAFLSQPCAVDVVYGEVWAGRLPLPVVDGKELFARGLLGVELGPDDVPPFAAKPDWCPVFLRASLRQFEGLEDADDVLVNSFHEIEPKEADYMALTWHAKTIGPTLPSFYLDDDRLPLNKTYGFNLFNSSESCLAWLDKQLPCSVVLVSYGTVSDYDETQLEELGNGLYNSGKPFIWVVRSNEEHKLSDELRDKCKERGLIVSWCPQLEVLAHKATGCFFTHCGWNSTLEAIVNGVPMVAIPHWADQPTISKYMESMWGLGVRVRKDEKGLVTRDEVERCIKDVMDGDSKDKYRKSATMWMQKAKSAMQNGGSSDKNITEFVAKYSLS

SEQ ID NO: 861 - protein, 470 aa, Zea mays
MGSTSTSATSSSSSSAASGAHVLLLPYPGAQGHTNPLLQFGRRLAYHGFRPTLVTSRYVLSTTPPPGEPFRVAAISDGFDGGGAAACPDIAEYYRQLEAVGSETLAELIRTEAAEGRPVRVVVYDPHLPWARWVAQAAGVPAVAFLSQPCSVDVIYGEVWAGRLPLPVVDGKELFARGLLGVDLGPDDVPPFAARPDWCPVFLRATVRQFEGLEDADDVLVNSFRDIEPTEADYMSLTWRAKTIGPTLPSFYLDDDRFPLNKAYGFNLFSSSDSCLPWLDKQRPRSVVLVSYGTVSDYDENQLEELGNGLYSSGKPFIWVVRSNEEHKLSDELRDKCKERGLVVSWCPQLEVLAHKATGCFFTHCGWNSTLEAIVNGVPMVAVPHWADQPTISKYMESVWGLGVKVRKDEKGLVTRDEVARCIKDVMDGDRKDEYRMNANVWMKKAKEAAQYGGSSDKNIAEFVAKYSSS

SEQ ID NO: 862 - protein, 460 aa, Setaria italica
MESTSASAGAHVLLMPYPGAQGHTNPLLEFGRRLAYHGLRPTLVSTRYLLSTIPPPGEPISVAAISDGFDDGGAASCPDLNDYLRQLEAVGSRTLAELLRSEAAEGRPVRVLVYDPHLPWARRVAKAAGVATAAFLSQPCSVDVVYGEVWAGRLPLPVTDGRELFTRGLLGVELGPDDVPPFAARPDWCPAFLKVSVRQFEGLEDADDVLVNSFHDMEPKEADYMALTWRAKTIGPTLPSFYLDDDRLPFNKTYGFNLFSSSVSCLAWLDKQLPCSVVLVSYGTVSDYDETQLEELGNGLCNSGKPFLWVVRSNEEHKLSCELRDKCKQHGLIVSWCPQLEVLEHKATGCFFTHCGWNSTLEAIVNGVPMVAIPHWADQPTISKYMESAWGLGVRVRKDEKGLLRRDEVERCIKEVMDGDRKDKYKANATMWKQKAKKAMQKGGSSDKNIAEFAAKYSSY

SEQ ID NO: 863 - protein, 481 aa, Zea mays
MGGKKIPSTTSCSPLPSTDSDHRGISDGHVLLLPYPGAQGHTNPLLQFGRRLAYHGLHPTLVTTRYVLSTTPPPGEPFRVADISDGFDDCGAAACPDLSEYWRQLQAIGSVTLAELIRSEASEGRPVRVLVYDPFLPWSRRVAQEAGVAAVAFLSQSCAVDVVYGEVLSGRLPLPVVNGKELFARGLLGVELGPDDVPPFVAKPDWCPLFLRASLQQFEGLEDADDVLVNSFHDIEPKEADYMALTWRAKTIGPTLPSFYLDDDRFPLNKTYGFNLFNSSEPCLAWLERQLPRSVILVSYGTISNYDEAQLEELGNGLYNSGKPFIWVVRSNEEHKLSDELRDKCKERGLIVSWCPQLEVLAHKATGCFFTHCGWNSTLEAIVNGVPMVAIPHWADQPTISKYMESMWGLGVRVRKDEKGMVTRDEVERCIKDVMDGDSKDKYRKSATMWMQKAKAAMQNGGSSDKNITEFAAKYSSSQKI

SEQ ID NO: 864 - protein, 92 aa, Sorghum bicolor
MASMMMGGDFVEAYVLKNAYKEKLRRMEAAEETKKGKLGSAAEKKVSGGGGRGGGGGGGLFGLLKKKVHPKAAAASPMETRSTEEEEEEASS

SEQ ID NO: 865 - protein, 166 aa, Saccharum officinarum
MDWGKSHAESELKRCLFLSACAEDNPTPTGASDGSSSCASAVALSFLGLNSVIAIYHSRHDPRSMLFVTVSFFCVVLLFHLLRVFERLPPGSPRRLQVKAAVWALTTTLTVMFSGRVAPLMPAPVAAVVRSMAAVTILAGFYLFFVCPDAAFTGDEKPACKVAESP

SEQ ID NO: 866 - protein, 326 aa, Secale cereale
MASTTAVPEVALRSGDARPMPAIGMGTAKFPMVPETTVKAVLEAVEVGYRHFDTASMYATERPLGEALAEAVRRGLLASREEVFVTSKLWCTQCHPHLVLPSLRESLQNLQMEYVDLYLIHWPISLKPGPAVFPVKREDAVPFDFEGVWRAMEECHRLGLAKAIGVSNFTTRHLDKLLTAATIPPAVNQVEMNPVWQQRKLRGYCAEKGIHVAAYSPLGGQNWSGDGNAVLDSEVLAEIAKARGKTVAQVALRWIYEQGATPIVKSFSKERLKENLGIFDWGLTDDDLRKIGQIPQKKIVKAAGVLFSAEGEFTSADLADMEIVEE

SEQ ID NO: 867 - protein, 326 aa, Hordeum vulgare
MASTTAVPEVALRSGDARPMPAIGMGTAKFPVVPETTMKAMLEAVELGYRHFDTASMYATERPLGEALAEAVRRGLLASREEVFVTSKLWCTQCHPHLVLPSLRESLRNLQMEYVDLYLIHWPISLKPGPAVLPVKREEAVPFDFEGVWRGMEECHRLGLAMAIGVSNFTTSHLNKLLAAAAVPPAVNQVEMNPVWQQRKLRDYCAEKGIHIAAYSPLGGQNWSGDGSAVLDSEVLAEIAGLRGKTVAQVALRWIYEQGATPIVKSFSKERLEENLGIFDWGLTDDDLRKIDQIPQKKIVTAAGVLFCAEGEFTSADIADMEIVEE

SEQ ID NO: 868 - protein, 331 aa, Aegilops tauschii
MGTAKLPVVPETTVKAVLEAVVVGYRHFDTASMYATERPLGEALEEAVRRGLLASREEVFVTSKLWCTQCHPHLVLPSLRESLQNLQMEYVDLYLIHWPISLKPGPAVFPVKREDAVPFDFAGVWRAMEECHRLGLAKAIGVSNFTTSHLHKLLAAATVPPAVNQVAEHNTTRSPSSTGLNIHWDSALAACGVQVEMNPVWQQRKLREYCAEKGIHVAAYSPLGGQNWSGDGNAVLDSEVLAEIAKARGKTVAQVALRWIYEQGATPIVKSFSKERLKENLGIFDWGLTDDDLRKIGQIPQKKIVRAETVLFSAEGEFTSADLAEMEIVEE

SEQ ID NO: 869 - protein, 323 aa, Brachypodium distachyon
MASVPEVTLRSGNARPMPAIGMGTAKFPVVPETTRDAVLAAVELGFRHFDTASMYSTEKPLGEAIAEAVRRGLVASRGEVFVTSKLWCTQCHPHLVLPSLRESLQNLQMEYVDLYLIHWPISLKPAPPVFPAKPEDAVPFDFEGVWRAMEECQRLGLAKAIGVSNFTTKHLDKLLATATVPPAVNQVEMNPAWQQRTLRKYCAEKGIHVAAYSPLGGQNWTGEGNAVMDSEVLAEIAQARGKSVAQVALRWIYEQGVTPIVKSFSKERLKENLEIFDWALTDDDLLKISQNPQKKVVKAIGILFPTEGEFTSVDPSDIDIVEE

SEQ ID NO: 870 - protein, 90 aa, Aegilops tauschii
MEFEMASQHGALLKVGLFVLVQALVYLILAQSSSVFSTTKTLGLPPARSLSARRMVALLSDLPLGGEPSPRAVSVEPSSPVPVHAHQKKD

SEQ ID NO: 871 - protein, 90 aa, Secale cereale
MELEMVSQHGALLKVGLFVLVQALVYLILAQSSSVFSSTKTLGLPPARSLSARRMVALLSDLPLGGEPSPRALSLLEPSSPVPLAYQKKD

SEQ ID NO: 872 - protein, 90 aa, Triticum aestivum
MEFEMASQHGALLKVGLFVLVQALVYLILAQSSSVFSTTKTLGLPPARPLSARRMVALLSDLPLGGEPSPRAVSVEPSSPVPVHAHQKKD

SEQ ID NO: 873 - protein, 92 aa, Triticum aestivum
MELEMVSQHGALLKVGLFVLVQALVYLILAQSSSVFSTTKTLGLPPARSLSTRRMVALLSDLPLGGEPSPRAGIVEPSSPVALAAHAHQKKD

SEQ ID NO: 874 - protein, 89 aa, Secale cereale
MEFEMVSQHGALLKVGLFVLVQALVYLILAQSSSVFSTTKTLGLPPTRSLSARRMVALLSDLPLAGEPSPRAAFTETSSPVPLAHQKKE

SEQ ID NO: 875 - protein, 92 aa, Secale cereale
MELEMVSQHGALLKVGLFVLVQALVYLILAQSSSVFSSTKTLCLPPARSLSARRMVALLSDLPLAGEPSPRGAFAEPSSPAALAAHAHQKKD

SEQ ID NO: 876 - protein, 92 aa, Avena sativa
MEFEMVASQHGALLKVGLFVLVQALVYLILAQSSSVFSSTKTLGKFRPSRSLSARRMVALLSDLPLAGEPSPRAVSGEPSSPVPMLAHQKKD

SEQ ID NO: 877 - protein, 90 aa, Secale cereale
MEFEMASLSQHGALLKVGLFVLVQALVYLILAQSSSVFSTTKSLRPADSLGARRMVALLSDLPLGGEPSPRAVSVEPSSPVPVHAHQKKD

SEQ ID NO: 878 - protein, 93 aa, Hordeum vulgare
MELEMMASQHGALLKVGLFVLVQALVYLILAQSSSVFSTTKNLGLPTAHSLGARRMVALLADLPLDGEPSARAGFVEPSSPVALAAHAHQKKD

SEQ ID NO: 879 - protein, 94 aa, Avena sativa
MEFEMVASQHGALLKVGLFVLVQALVYLILAQSSSVFSSTKTLGKLRPSRSLSARRMVALLSDMPLAGEPSPRAVSGELSSPVPMPVASHQKKD

SEQ ID NO: 880 - protein, 176 aa, Hordeum vulgare
MASSTALSCLATLLLLAAAAAPASAAEKETRLRVYWHDVVSGGPNARVVQVAQAPSSNASATGFGTVLVIDDPLTEGPNLTSRLLGRAQGIYVSAGKDSLSLLMAMNFVFVDGAYNGSSIAIIGPNQADRAVREMPVVGGTGIFRFARGYCQLRTHWFDAKTGDATVEYKIHLRHD

SEQ ID NO: 881 - protein, 176 aa, Secale cereale
MASSTALSVLAALLLLAAAGAPASAAEKETRLRVYWHDVVSGGPNARVVQVAEAPSSNASATGFGTVLVIDDPVTEGPNLTSRLLARAQGMYISAGKDSVSLFVAMNFVFVDGAYNGSSIAIFGANQADRAVREMPVVGGTGVFRFARGYCQLRTYRFDAKTGDATVEYMIHLRHD

SEQ ID NO: 882 - protein, 177 aa, Triticum aestivum
MASSTAISCLAALLLLAAAAAPASAAEKETRLRVYWHDVVSGGPNATVAQVAQAPSSNASATGFGGVSVIDDPLTEGPSLTGSRLLGRAQGLYVSTGKDSLSLLMAMNFVFVDGAYNGSSIAIVGPNPVNRAVREMAVVGGTGVFRFARGYCQLRTHWFDANTGDATVEYRVHLRHD

SEQ ID NO: 883 - protein, 176 aa, Hordeum vulgare
MVSSTALSVLAALLLLAAAGAPASAAEKETRLRVYWHDVVSGGPNATAVQVAEAPSSNASATGFGSVVVIDNSLTDGPNLTSRLLGRAQGVYVSAGKDSLSLFVAMNFVFIDGEYNGSSIAIIGPNRADPAVREMPVVGGTGVFRFARGYCQLRTHWFDAKTGDATVEYKIHLRHD

SEQ ID NO: 884 - protein, 148 aa, Aegilops tauschii
GLAALLLLAAAGAPVSAAEKETRLRVYWHDVVSGGPNARVVQVAQAPSSNASATGFGTVLVIDDPLTEGPNLTSRLLGRAQGMYISAGKDSLSLLMAMNFVFVDGAYNGSSIAIIGPNQADRAVREMPVVGGNGVFRFARGYCQLRTH

SEQ ID NO: 885 - protein, 263 aa, Aegilops tauschii
MSSSSSAPAAAVPTSTRLILVHGTGHGGWCWYKVATLLRAAGHRVDAPDLAACGSDARRLSDAPTFEDYTRPLLDALRDLPDGERAVLVGHSFGGMSIALAAEEFPDKVAAAVFLTAFMPDCDGPRTRVIEEVPVSDWMDSVVDEEHAPPSVFLGPEFVRRKLYQLTSEEDYTLCQSLARVSSYYVADQQQRPPFSAARYGAVTKVYVIAKQDLAMVEEYQRQMIAGIPVAEVREMADADHMAMLSAPEELAGHLADIANNYT

SEQ ID NO: 886 - protein, 263 aa, Secale cereale
MSSSSSAPALAVATSTRLILVHGTGHGGWCWYKVVTLLRAAGHRVDAPDLAACGADARRLRDAPTFEDYTRPLLDALRALPDGQRAVLVGHSFGGMSVALAAEELPDKVAAAVFLTAFMPDCDGPRTRVVEEVPVSDWMDSVVDDEHAPPSVFLGPDFVRRKLYQLSPEEDYTLCQSLARVSSYYVADQQQRPPFTAARYGAVTKVYVVAKQDLAMVEEYQRRMIAGIPVAEVREMAGADHMAMLSAPEELAGHLADIANTYT

SEQ ID NO: 887 - protein, 264 aa, Brachypodium distachyon
MSSSSMLPAAATAASKRLILVHGTGHGGWCWYKVATLLRAAGHRVDAPDMAASGADARPLRDAPTFEDYSRPLLDALRALPPGEKAVLVGHSFGGMSVALAAEEFPDKVAAAVFLTAFMPDCAHPRTHTIEALPAGLDWMDSVTDEGHAPPSVFLGPQFLRRMLYQLCPEEDYTLSQSLARVSSYYVADQRRRPPFSADRYGAVSKVYVVAKQDLAMVEQYQRQMIASVPVAEVREMAGADHMAMLSAPEVLAGHLADIANTYA

SEQ ID NO: 888 - protein, 196 aa, Hordeum vulgare
MGAKLSCFSNHRGGLSQQPRQPAPVRVIAADGSLKELPASPGVTVSDVLGGSAASFFVCNSDALYFDQSPPALASGEVLRPGQIYFVLPAALQRRPLSSAEMVSLAVRASSAIADKKPQQRRGRFSGGKKKVRVMPVHEELEDGEDVLLNEKLNERTLGEFAVSPKSEEKIAVVGARSRLKMKLKRALSIIQEVAE

SEQ ID NO: 889 - protein, 513 aa, Hordeum vulgare
MEMCSVPFFYVAAITFLTVLLLHSFLTKKRRLPPGPALALPFLGHLPFLKKPLHATLARLAARHGPVFSLRLGSRPAVVVTSWEVAKECFSSDLDATLANRPHFPSVREVSFDYSVLTLANYGAHWRAARRVAVVHLLSARRVDLMSDAVVARELRALVRRLARLTAGGGGSAARVELKRRLFDLSHSVLMEALARSRNTYSDDEADMSQEAREMKDVVDAIVPLVGVANLWDYLPVLRWFDWRGVRRQLEDVTSRRNAFIYKLIDRERQKQQKQEEEQGMIGVMLSLQKSEPDLYTDTFIAALVANLLGVGTETTSTTTEWAMALLLNHPAVLKKAQEEIDAHLSGEPSRLLDKTDLPHLPYLHCIISETMRLCPAAPLLLPHEAAADCQLHGYDVAAGTIVLVNAYAIHRDPAAWGPAPEEFRPERFEDGVAEGKLMMPFGMGRRKCPGESLAMRTMGLVLGTLIQCFDWARIGDEDVDMASSSGTVMLKAVALEALCTPRAGMDALLHKL

SEQ ID NO: 890 - protein, 91 aa, Secale cereale
MQRSNSFGTSWADQWDTGADPSPRARGNGNGGNGDGKKGGVEKTKAAAATGLKKVKAGTAQGFQWIKDKYQKKSAGKNGKQGAGSEVAAGY

SEQ ID NO: 891 - protein, 89 aa, Secale cereale
MQRSNSFGTSWADQWDTGADPSPRARGNGGGGDGKKGGVEKTKAAAATGLKKVKAGTAQGFQWIKDKYQKKSAGKNGKQGGSSEVAAGY

SEQ ID NO: 892 - protein, 90 aa, Secale cereale
MQRSNSFGTSWADQWDTGADPSPRARGGNGGGGDGKKGGVEKTKAAAATGLKKVKAGTAQGFQWIKDKYQKKSAGKNGKQGAGSEVAAGY

SEQ ID NO: 893 - protein, 90 aa, Hordeum vulgare
MQRSSSFGTSWADQWDTGADPSPRARGGNGNGKKVQGGGVEKTKAAAATGLKKVKAGTAQGFQWIKDKYQKKSAGKNGKQGGGSEVAAGY

SEQ ID NO: 894 - protein, 247 aa, Lolium multiflorum
MADYHRVHPVIAGSPPEQTKDKIPPSATHGEQVLPITAPPPYAPAPMRAPRRKRHSRCCRCVCWTLVVAIVLVVALGATAGILYAVFRPKIPTFNVDRLTVTRFDVNTTTAVVTDAFEVQVTANNPNRRIGVYYDGGEVTASFNGTELCSGAFPALYQGHRTTVRPLITLQGETRLDSAVAAQLAQQQQAGFIPLTVNARVPIRIKFGVIKLWKMTGKARCNLVVDRLQAETRLRIRSNSCSFKLKI

SEQ ID NO: 895 - protein, 496 aa, Secale cereale
MTLAGSGDGQSGSARAHFVLVPMMAQGHTIPMTDMARLLAEHGAQVSFITTPVNAARLEGFAADVKAAGLAVQLVELHFPAAKFGLPDGCENIDMIQSKKFFSNFMQACGALQEPLMAYLREQQSSPPSCIISDMMHWWTGDIARELGIPRLTFSGFCGFSSLVRYIIFHNSVLEHVTDDNELVTIPGFPTPLELMKAKLPGTLSVPGMEQIREKMFEEELRCDGEITNSFKELETLYIESFEQITRKKVWTVGPMCLCHRNSNTMAARGNKASTDEAQCLQWLDSRKTGSVIFVSFGSLACTTPQQLVELGLGLEASKKPFIWVIKAGPKFPEVEEWLADGFEERVKDRGMIIRGWAPQVMILWHQAIGGFVTHCGWNSTIEGICAGVPMITWPHFAEQFLNEKLVVDVLKIGVEVGVKGVTQWGIEKQEVMVRRDAVETAVNTLMDEGEAAEELRVRAKDCAIKARRAFDEEGSSYNNVRLLIQEMGNKTNPCD

SEQ ID NO: 896 - protein, 496 aa, Triticum aestivum
MTFAGSGDGQSGSARAHFVLVPMMAQGHTIPMTDMARLLAEHGMQVSFITTPVNAARLEGFTADVKAAGLAVQLVELHFPAAEFGLPDGCENLDMIQSKNLFLNFMETCAALQEPLMAYLREQQRSPPSCIISDMMHWWTGDIARELGIPRLTFSGFCGFSSLVRYIIFHNNLLEHVTDDNELITIPGFPTLLELTKAKLPGTLCVPGMEQIREKMYEEELRCDGEITNSFKELETLYIESYEQIARKKVWTIGPMCLCHRNSNTTAARGNKAPMDEAQCLQWLDSRKPGSVIFVSFGSLACTTPQQIVELGLGLEASKKPFIWVIKAGPKFPEVEEWLADGFEERVKDRGMIIRGWAPQVMILWHQAIGGFVTHCGWNSTIEGICAGVPMITWPHFAEQFLNEKLVVDVLKLGVEVGVQGVTQWGSEQQEVMVTRDAVETAVNTLMGEGEATEELRMRAEDCAIKARRAFDEEGSSYNNVRLLIQEMENKTNACG

SEQ ID NO: 897 - protein, 496 aa, Secale cereale
MTLAGSGDGQSGSARAHFVLVPMMAQGHTIPMTDMARLLAEHGAQVSFITTPVNAARLEGFAADVKAAGLAVQLVELQFPSVEFGLPDGCENLDMIQSKNLFLNFMETCAALQEPLMAYLREQQRLPPSCIISDMMHWWTGDIARELGIPRLTFSGFCGFSSLVRYIIIHKNVLEHVTDDNELITIPGFPTPLELMKAKLPGTLSVPGMEQIREKMFEEELRCDGEITNSFKELETLYIESYEQITKKKVWTIGPMCLCHRNSNRTAARGNKASMDEAQCLQWLDSRKPGSVIFVSFGSLACTTPQQLVELGLGLEASKKPFVWVIKAGAKLPEVEEWLADGFEERVKDRGLIIRGWAPQVMILWHQAVGGFVTHCGWNSTIEGICAGVPMITWPHFAEQFLNEKLVVDVLKLGVEVGVQGVTQWGSEQQEVMVTRDAVETAVNTLMGEGEATEELRMRAEECAIKAKRAFDEEGSSYNNVRLLIQEMRNKTKACG

SEQ ID NO: 898 - protein, 496 aa, Hordeum vulgare
MNFAGSGDGRSGSARAHFVLVPMMAQGHTIPMTDMARLLAEHGAQVSFITTPVNAARLEGFAADVKAAGLAVQLVELHFPAAEFGLPDGCENLDMIQSKNLFLNFVEACAALQEPLMAYLRQQQRSPPSCIISDVMHWWTGDIARELGIPRLTFIGFCGFSSLVRYIIFHNNVLEHATDENELITIPGFPTPLELMKAKLPGTLSVPGMEKIREKMFEEELRCDGEITNSFRELEALYVEFYEQIRKKKIWTVGPMCLCHRNSNTTAARGNKASMDETQCLQWLDSRKPGSVIFVSFGSLACTTPQQLVELGLGLEASQKPFIWVIKAGPKFPEVEEWLADGFEARVKDRGMILRGWAPQVMILWHQAIGGFVTHCGWNSTIEGICAGVPMITWPHFSEQFVNEKLVVDVLKIGVEVGVKGVTQWGSEKQEVMVTRDAVETAVNTLMGEGEAAEELRMRAKDCAIKARRAFDEEGSSYNNVRLLIQEMENKTNPCD

SEQ ID NO: 899 - protein, 497 aa, Aegilops tauschii
MTLSRSGDGQSGSARAHFVLVPMMAQGHTIPMTDMARLLAEHGAQVRFITTPVNAARLEGFAADVKAAGLAGQLVELHFPSVEFGLPDGCENLDMIQSKNLFLNFMKACAALHEPLMAYLREQQHSPPSCIISDMAHWWTGDIARELGIPRLTFSGFCGFSSLVRYIIFHNNVLEHVTDDNELITIPGFPTPLELTKAKLPGGTLCVPGMEQIREKMFEEELRCDGEITNSFKELETLYIESYEQITRKKVWTIGPMCLCHRNSNRTAARGNKASMDEAQCLQWLDSRKPGSVIFVSFGSLACTTPQQLVELGLGLEASKKPFVWVIKAGAKLPEVEEWLADGFEERVRDRGLIIRGWAPQVMILWHQAVGGFVTHCGWNSTIEGICAGVPMITWPHFAEQFLNEKLVVDVLKLGVEVGVQGVTHWVTEQQEVMVTRDAVETAVNTLMGEGEATEELRMRAKDCAIKARRAFDEEGSSYNNVRLLIQEMSNKTNACG

SEQ ID NO: 900 - protein, 496 aa, Triticum aestivum
MTFAGSGDGQSGSARAHFVLVPMMAQGRTIPMTDMACLLAEHGAQVSFITTPVNAARLEGFAAKVEAAGLVVQLVELHFPSVEFGLPDGCENLDMIQSKNLFFNFMKACAALHEPLMAYLREQQRSPPSCIISDMAHWWTGDIARELGIPRLTFSGFCGFSSLVRYIVFHNNVLENVTDDNELITIPGFPTPLELTKAKLPGTLCVPGMEQIREKMFEEELRCDGEITNSFKELETLYIESYEQITRKKVWTIGPMCLCHRNSNRTAARGNKASMDEAQCLQWLDSRKPGSVIFVSFGSLACTTPQQLVELGLGLEASKKPFVWVIKAGAKLPEVEEWLADGFEERVKDRGLIIRGWAPQLMILQHQAVGGFVTHCGWNSTIEGICAGVPMITWPHFGEQFLNEKLLVDVLQIGMEVGVKGVTQWGSENQEVMVTRDAVETAVNTLMGEGEATEELRMRAEDCAIKARRAFDEEGSSYNNVRLLIQEMGNKTNACG

SEQ ID NO: 901 - protein, 459 aa, Aegilops tauschii
MTFAGSGDGESGSERAHFVLVPMMAQGHTIPMTDMARLLAEHGAQVSFITTPVNAARLEGFAADRQAAGLAVQLVELHFPAAEFGLPDGCENLDMIQSKNLFLNFMETCAALQEPLMAYLREQQRSPPSCIISDMMHWWTGDIARELGIPRLTFSGFCGFSSLVRYKHKKANLQIREKMYEEELRCDGEITNSFKELETLYIESYEQIARKKVWTIGPMCLCHRNSNTTAARGNKAPMDEAQCLQWLDSRKPGSVIFVSFGSLACTTPQQIVELGLGLEASKKPFIWVIKAGPKFPEVEEWLADGFEERVKDRGMIIRGWAPQVMILWHQAIGGFVTHCGWNSTIEGICAGVPMITWPHFAEQFLNEKLVVDVLKLGVEVGVQGVTQWGSEQQEVMVTRDAVETAVNTLMGEGEATEELRMRAEDCAIKARRAFDEEGSSYNNVRLLIQEMENKTNACG

SEQ ID NO: 902 - protein, 510 aa, Triticum aestivum
MTLSGSGDGQSGSVRAHFVLVPMMAQGHTIPMTDMARLLAEHGAQVSFITTPVNAARLEGFAADVKAAGLAVQLVELHFPAAEFGLPDGCENLDMIQSKNLFLNFMKACAALQEPLMAYLLEQQRLPPSCIISDMVHWWTGDIARELGIPRLTFSGFCGFSSLVRYITYHNNVFQNVKDENELITITGFPTPLELTKAKCPGNFCIPGMEQIRKKFLEEELKSDGEVINSFQELETLYIESLEQTTKKKVWAVGPMCLCHRDNNTMAARGNKASMDEAQCLQWLDSMKPGSVVFVSFGSLACTTPQQLVELGLGLETSRKPFIWVIKAGAKLPEVEEWLADEFEERVKNRGMVIRGWAPQLMILQHQAIGGFVTHCGWNSTIEGICAGVPMITWPHFGEQFLNEELLVDVLKIGMEVGVKGVTQWGSENQEVMVTRDEVQKAVNTLMDEGVAAEEMRVRAKDCAIKARRAFDEGGSSYDNIRLLIQEMEIKTNACRSVVDTDGNKLSFLV

SEQ ID NO: 903 - protein, 510 aa, Triticum aestivum
MTFAGSGYGERGSKRAHFVLVPMMAQGHTIPMTDMARLLAEHGAQVSFITTAVNAARLEGFAADVKAAGLAVQLVELHFPAAEFGLPDGCENLDMIQSKNLFLNFMKACAALQEPLMAYLREQQRSPPSCIISDLVHWWTGDIARELGIPRLTFSGFCGFSSLIRYITYHNNVFQNVKDENELITITGFPTPLELTKAKCPGNFCIPGMEQIRKKFLEEELKSDGEVINSFQELETLYIESFEQTTKKKVWAVGPMCLCHRDNNTMAARGNKASMDEAQCLQWLDSMKPGSVVFVSFGSLACTTPQQLVELGLGLETSRKPFIWVIKAGAKLPEVEEWLADEFEERVKNRGMVIRGWAPQLMILQHQAVGGFVTHCGWNSTIEGICAGVPMITWPHFGEQFLNEKLLVDVLKIGMEVGVKGVTQWGSENQEVMVTRDEVQKAVNTLMDEGAAAEEMRVRAKDCAIKARRAFDEGGSSYDNIRLLIQEMEIKTNACGSVVDRDGNKLSFLV

SEQ ID NO: 904 - protein, 496 aa, Hordeum vulgare
MTFTSSGDGQSGSMRAHFVLVPMLAQGHTIPMTDMARLLAEHGAQVSFITTPVNAARLAGFAADVEAAGLAVRLVELYFPSTEFGLPDGCENLDMIHSTDLLSNFMDAIAALQEPLKAYLREQQCSPPSCVISDLIHWWTGDIARELRIPRLTFSGFCGFSSLIRYITFHNNVFENVKDENELITITGFPTPLEITKAKCPGGFSIPGMEQTRKKFLEEELKSDGEVTNSYQELEALYIESFEQTTKKKAWAIGPMCLCHRDNNTMATRGNKASMDEAQYLQWLDSMKPGSVVFVSFGSLACTTPQQLVELGLGLEASRKPFIWVIKAGAKLPEVEEWLADGFEERVKNRGMVIRGWAPQLMILRHQAVGGFVTHCGWNSTIEAICAGVPMITWPHFGEQFLNEKLVVDVLRIGVEVGVKGVTWWGNEKQEIVVTRDEVEKAVSTLMDEGAAAEETRVRAKDCAIKARKAFDEGGSSYDNIRLLIQEMGSRTNACG

SEQ ID NO: 905 - protein, 510 aa, Triticum aestivum
MTFTGSGDGQSGSARAHFVLVPMLAQGHTIPMTDMARLLAEHGAQVSFITTPVNASRLAGFAADVEAAGLAVRLVELHFPSAEFGLPDGCENLDMIQSTDLLSNFMDAIAALQEPLKAYLHEQQRSPPSCIISDLIHWWTGDIARELGIPRLTFSGFCGFSSLIRYITYHNNVFQNVKDENELITITGFPTPLELTKAKCPGNFCIPGMEQIRKKFLEEELKSDGEVINSFQELETLYIESFEQTTKKKIWAVGPMCLCHRDNNTMAARGNKASMDEAQCLQWLDSMKPGSVVFVSFGSLACTTPQQLVELGLGLETSRKPFIWVIKAGAKLPEVEEWLADEFEERVKNRGMVIRGWAPQLMILQHQAVGGFVTHCGWNSTIEGICAGVPMITWPHFGEQFLNEKLLVDVLKIGMEVGVKGVTQWGSENQEVMVTRDEVQKAVNTLMDEGAAAEEMRVRAKDCAIKARRAFDEGGSSYDNIRLLIQEMEIKTNACGSVVDTDGNKLSFLV

SEQ ID NO: 906 - protein, 498 aa, Brachypodium distachyon
MTFANGEESGRARAHFVLVPMMAQGHTIPMTDMARLLAQHGAQVSIITTPVNASRLAGFIADVDAAGLAVQLVQLRFPAVEFGLPDGCENLDLVQSSDLLVNFLDACGALREPLAALLREQQHPPPSCIISDVMHWWTGDIARELGIPRLAFIGFCGFSSLARYIIFHHKVFEDVTDENELITIPGFPTPLELTKAKSPGGIVIPGIESIRDKILEEELRCDGEVMNSFQELETLYIESFEQMTGKKVWTVGPMCLCNQDSNTMAARGNTASMDEAQCLQWLDSMKPGSVIFVSFGSLACTAPQQLIELGLGLEASKKPFIWVIKAGDKFPEVEEWLADGFEKRVKDRGMIIRGWAPQVMILWHQAIGGFMTHCGWNSTIEGICAGVPMITWPHFAEQFLNEKLLVDVLKTGVEVGVKEVTQWGQEHKEVMVTRNAVEKAVCTVMDEGEAAEELRMRAKDYAIKAKRAFSEEGSSYNNVRLLIQEMGNRTNAWGVNIK

SEQ ID NO: 907 - protein, 510 aa, Aegilops tauschii
MTFTGSGDGQSGSARAHFVLVPMLAQGHTIPMTDMARLLAEHGAQVSFITTPVNASRLAGFAADVEAAGLAVRLVELHFPSAKFGLPDGCENLDMIQSTDLLSNFMDAIAALQEPLKAYLHEQQRSPPSCIISDLIHWWTGDIARELGIPRLTFSGFCGFSSLIRYITYHNNVFQNVKDENELITITGFPTPLELTKAKCPGNFCIPGMEQIRKKFLEEELKSDGEVINSFQELETLYIESFEQTTKKKVWAVGPMCLCHRDNNTMAARGNKASMDEAQCLQWLDSMKPGSVVFVSFGSLACTTPQQLVELGLGLETSRKPFIWVIKAGAKLPEVEEWLADEFEERVKNRGMVIRGWAPQLMILQHQAVGGFMTHCGWNSTIEGICAGVPMITWPHFGEQFLNEKLLVDVVKIGMEVGGKGVTQWGSENQEVMVTRDEVQKAVNTLMDEGAAAEEMRVRAKDCAIKARRAFDEGGSSNDNIRLLIQEMEIKTNACGSVVDTDGNKLSFLV

SEQ ID NO: 908 - protein, 494 aa, Brachypodium distachyon
MTFVSSGQSEPPRAHFVLVPMMAPGHSIPMTDMARLLAEHGAQVSFITTPVNASRLAGFIADVDAAGLAVQLVQLRFPTAEFGLPDGCENLDLVQSRDLLLNFMEACAALREPLAAHLREQQHLPPSCIISDMMHWWTGDIARELGIPRLAFIGFCGFSSLARYIAFHHKVFEDVTDENELITIPGFPTPLELTKAKSPGGIVIPGLERIREKILEEDLRCEGEVLNSFQDLETLYIESFEQMTGKKVWTVGPMCLCNQDSNTMAARGNKASMDEAQCLQWLDSMKPGSVILVSFGSLTCTAPQQLIELGLGLEASKKPFIWVIKAGDKFPEVEGWLADGFEERVKDRGMIIRGWAPQVMILWHQAIGGFMTHCGWNSTIEGICAGVPMITWPHFGEQFLNEKLLVDVLKIGVEVGVKRVTHWGQEQKEVMVTRNAVEKAVYTVMDDGEAAEELRMRAKDYAIKAKMAFNEEGSSYNNVSLLIQEMRKRTNASA

SEQ ID NO: 909 - protein, 81 aa, Zea mays
MASAGRRPTVLKQIALFLVVAAVIMNSSVCLGAAGHDATVVGTGSNDPNHPAFPSPPGKPYTGRPCSKIYGCNVPPAGGQP

SEQ ID NO: 910 - protein, 351 aa, Sorghum bicolor
MAPRQPLLPSFLYAASSPGGRDARPPVVVARAPSEPPFGKIEMFSPAYYAAGAIGGAAACGFTHAAVTPLDVIKCNIQIDPAKYKSTSSAFGVVMREQGLRGFFRGWAPTFVGYSAQGAFKYGLYEFFKKKYADMAGPEYAAKYKTVIYLAGSATAEVFADVALCPMEAVKVRVQTQPGFARGLSDGFPKIVRAEGYAGLFRGLVPLWGRQIPYTMMKFATYENIVEVTYKHLIPTPKDECSKPLQLGVSFGSGYVAGVFCAAVSHPADNLVSFLNNSKGATVGDAVKNLGLLGLFTRGLPLRILMVGTLTGAQWVIYDSFKVMIGLPTTGGAPAPTTVPLEGLGELKASA

SEQ ID NO: 911 - protein, 354 aa, Setaria italica
MAPRQQQPLLPSFLYAPRPGASGRREAPPAAVVAGAPSEPFGKIEMFSPAYYAAGAVGGAAACGFTHAAVTPLDVIKCNIQIDPAKYKSTSSAFGVVMREQGLRGFFRGWAPTFLGYSAQGAFKYGLYEIFKKEYTDLAGPEYADKYKTLIYLAGSATAEVFADIALCPMEAVKVRVQTQPGYARGLRDGFPKIVRSEGYAGLFRGLVPLWGRQIPYTMMKFATYENIVEMTYKHLISTPKDQCSKPLQLGVSFGSGYIAGVFCAAVSHPADNLVSFLNNSRGATVGDAVKNLGLMGLFTRGLPLRILMVGTLTGAQWVIYDSFKVMIGLPTTGGAPAPTTVPLEGLAELKASA

SEQ ID NO: 912 - protein, 359 aa, Panicum virgatum
MAPRQQQQQPLLPSFLYAPPPGATGGREAPPAPAVVAGAPSEPPFGKIEMFSPAYYAAGALGGAAACGFTHAAVTPLDVIKCNIQIDPAKYKSTSSAFGVVMREQGLRGFFRGWAPTFLGYSAQGAFKYGLYELFKKKYSDLAGPEYAAKYKTLIYLAGSATAEVFADVALCPMEAVKVRVQTQPGYARGLRDGFPKIVRSEGYAGGLFRGLVPLWGRQIPYTMMKFATYENIVEMTYKHLIPTPKDQCSEPLQLGVSFGSGYVAGVFCAAVSHPADNLVSFLNNAKGATVGDAVKNLGLVGLFTRGLPLRILMVGTLTAAQWMIYDSFKVMIGLPTTGGAPAPTTVPTEGLAELKASA

SEQ ID NO: 913 - protein, 359 aa, Panicum virgatum
MAPCQQQQQPLLPSFLYAPPPSGATGGREAPPAPAVVAGAPSEPPFGKIEMFSPAYYTACAVSGAAACGFTHTAVTPLDVIKCNIQIDPAKYKSTSSAFGVVMREQGLRGFFRGWAPTLLGYSAQGAFKYGIYEVLKKKYSDLAGPEYAAKYKTLIYLAGSATAEVFADVALCPMEAVKVRVQTQPGYARGLRDGFPKIVRSEGYAGLFRGLVPLWGRQIPYTMMKFATYENIVEMTYKHLIPTPKDQCSKPLQLGVSFGSGYVAGVFCAAVSHPADNLVSFLNNSKGATVGDAVKNLGLVGLFTRGLPLRILMVGTLTGAQWVIYDSFKVMIGLPTTGGAPAPTTVPMEGLAELKASA

SEQ ID NO: 914 - protein, 349 aa, Oryza sativa
MAPRNSLLPSFLYDGVGGGGGGAPAVVAGAPSEPPFGMIELFSPAYYSACAFGGAAACGLTHAAVTPLDVIKCNIQIDPTKYKSTTSAFGVVMREQGARGFYRGWAPTFLGYSAQGAFKYGLYEVFKKEYADMAGPEYAARYKTLIYLAGSATAEVAADVALCPMEAVKVRVQTQPGYARGLSDGFPKIVRNESYAGLFRGLVPLWGRQIPYTMMKFATYENIVEMAYKHLIPTPKEQCSKPLQLGVSFGSGYIAGVFCAAVSHPADNLVSFLNNSKGATVGDAVKNLGLWGLFTRGLPLRILMIGTLTGTQWVIYDSFKVMVGLPTTGGAPAPAAIPIGELAELKASA

SEQ ID NO: 915 - protein, 346 aa, Triticum aestivum
MASRQSLLPSFLYAASSGAGMPGGRAAQEPPVVARAPSEPPFGKIEMFSPAYYAACGFGGAAACGLTHAAVTPLDVIKCNIQIDPAKYKSISSSFSIVLKEQGVRGFFRGWAPTFLGYSAQGAFKYGLYEVFKKEYTDMAGPEYAAKYKTLIYLAGSATAEVVADVALCPMEAVKVRVQTQPGYARGLRDGFPKIVRAEGYAGLFRGMVPLWGRQIPYTMMKFATYENIVEMAYKHLIPTPKEQCSKPLQLGVSFGSGYIAGVFCAAISHPADNLVSFLNNAKGATVGDAVKNLGLWGLFTRGLPLRIVMIGTLTGTQWVIYDSFKVMAGLPTTGGTPAAAPREEA

SEQ ID NO: 916 - protein, 343 aa, Aegilops tauschii
MASRQSLLPSFLYAASSGAAMPDGRGAPVVARAPSEPPFGKIDMFSPAYYAACGFGGAAACGLTHAAVTPLDVIKCNIQIDPAKYKSISSSFSIVLKEQGVRGFFRGWAPTFLGYSAQGAFKYGLYEVFKKEYTDMAGPEYAAKYKTLIYLAGSATAEVVADVALCPMEAVKVRVQTQPGYARGLRDGFPKIVRAEGYAGLFRGMVPLWGRQIPYTMMKFATYENIVEMAYRHLIPTPKEQCSKPLQLGVSFGSGYIAGVFCAAISHPADNLVSFLNNAKGATVGDAVKNLGLWGLFTRGLPLRIVMIGTLTGTQWVIYDSFKVMAGLPTTGGAPAAAPREEA

SEQ ID NO: 917 - protein, 346 aa, Secale cereale
MASRQSLLPSFLYAASSGAAMPGGRGAQEAPVVARAPSEPPFGKIDMFSPAYYAACGFGGAAACGLTHAAVTPLDVIKCNIQIDPAKYKSISSSFSIVLKEQGVRGFFRGWAPTFLGYSAQGAFKYGLYEVFKKEYTDLAGPEYAAKYKTLIYLAGSATAEVVADVALCPMEAVKVRVQTQPGYARGLRDGFPKIVRAEGYAGLFRGMVPLWGRQIPYTMMKFATYENIVEMAYKHLIPTPKEQCSKPLQLGVSFGSGYIAGVFCAAISHPADNLVSFLNNARGATVGDAVKNLGLWGLFTRGLPLRIVMVGTLTGTQWVIYDSFKVMAGLPTTGGAPAAAPREEA

SEQ ID NO: 918 - protein, 352 aa, Lolium multiflorum
MARQSLLPSFLYSPSRSGGAGMPDGRGASGVVAGSPSEPPFGKIEMFSPAYYAACGVGGAAACGLTHAAVTPLDVIKCNIQIDPAKYKSISSAFGIVLKEQGFRGFYRGWAPTFLGYSAQGAFKYGLYEVFKKQYSDMAGPEYAAQYKTLIYLAGSASAEVIADVALCPMEAVKVRVQTQPGYARGLRDGFPKIVRSEGYAGLFRGMVPLWGRQIPYTMMKFATYENIVEMAYKHLIPTPKDQTSKPVQLGVSFGSGYVAGVFCAAISHPADNLVSFLNNAKGATVADAVKNLGVWGLFTRGLPLRILMIGTLTGTQWVIYDAFKVMAGFPTTGGAPAAVRKEELTEGQASA

SEQ ID NO: 919 - protein, 235 aa, Sorghum bicolor
MAASARPGERATSFTVACSLLSRFVRQNGAAAAELGLGIKGEVEQQRTPATISLLPGAEGEEAERTKETMELFPQSAGFGVKDAAAPSEQENKEKPKQLTIFYGGKVLVFDDFPADKAKDLMQLASKGSLVVQNVVLPQPSAPAAVTDKAVPAPVISLSAAQADAKKPARTNASDMPIMRKASLHRFLEKRKDRLNAKTPYQTSPSDAAPVKKEPESQAWLGLGPNAVKSNLSLS

SEQ ID NO: 920 - protein, 237 aa, Zea mays
MAASARPGERATSFAVACSLLSRFVRQNGAAPAQLGLGIKGEVEQQRTPATINLLPGADGEETERRKETMELFPQSAGFGVKDAAAAPREQENKEKPKQLTIFYGGKVLVFDDFPADKAKDLMQLASKGSPVVQNVVLPQPSAPAAAVTDKAVPVPVISLPAAQADAKKPTRTNASDMPIMRKASLHRFLEKRKDRLNANAPYQTSPSDAAPVKKEPESQAWLGLGPNAVKSNLNLS

SEQ ID NO: 921 - protein, 234 aa, Saccharum officinarum
MAASARPGERATSFAVACSLLSRFVRQNGAAAAELGLGIKGEVEPQRTPATISLLPGAKGEEAERRKETMELFPQSAGFGVKDGAAPREQENKEKPKQLTIFYGGKVLVFDDFPADKAKDLMQVASKGSPVVQNVVLPQPPAPAVVTDKAVPAPVISLSAAQADAKKPARTNASDMPIMRKASLHRFLEKRKDRLNAKTPYQTSSDAAPVKKEPESQAWLGLGPNAVKSNLSLS

SEQ ID NO: 922 - protein, 583 aa, Panicum virgatum
MESVKAWVAANYAEPMTSMQQSLRVAYVVFSFCAAFFLGGIKAMVVGPVAAALMILGNVGVILVLFPAHVWWTIYSLVKTDRINSGLKLAVLLALPVLFGLWLGLGIFGSALVALGYGFFTPWISTFEAFRQESEAKKFVHGIVDGTWGTIKGSCTVVRDFADMCFHSYPVYLKELRESSQDREPHSIRLLDVPSCIVVALLGLVVDIPLYTVIALIKSPYMLFKGWQRLLHDLISREGPFLETVCVPIAGLAILFWPLAVVGSILLAIVSSIFVGLYGAVIVFQEKSFQRGVSYVVAMVAEFDEYTNDWLYLREGTILPKPSYRKRKSSNSTEFSVRTNASVKGAEHPSGSSAAPAMLVPNLAPARSVREAIQEVKMVQIWENTMKACEQRGRDLLNLNVITAVGLSEWLRGKESGHETISLGLPSYSLLCSVLQSIKAGAGGLLMGSVEVNQFNRPQDRLLDWFFHPVLVLKEQIQVLSMTEEEVRFLEKLTLFVGNAAGGSAWDNGDEVPQDPVRLAQIQAISRRLVGIVRSLSKFPTYRRRYRHVVKLLIAYSIERDGSCWSSASNHSVSLFEITQLDV

SEQ ID NO: 923 - protein, 537 aa, Brachypodium distachyon
MAALAIRAAFAAVATSLAVYWLLNSSFLQTPNIALSLPAAAAAFVVVAIAASGPGHRSDGTPPGPAALPVLGNWLQVGNDLNHRFLARLSARYGPVFRLRLGVRNLVVVSDPRLATEVLHTQGVEFGSRPRNVVFDIFTANGADMVFTEYGDHWRRMRRVMTLPFFTARVVQQYRAMWEAEMDAVVSDLRADPVARVAGVVVRRRLQLMLYNIMYGMMFDARFESVDDPLFVQATRFNSERSRLAQSFDYNYGDFIPILRPFLRGYLNKCRDLQSRRLAFFNNNYVEKRRKVMDSPGDKDKLRCAIDHILAAEKNGEITAENVIYIVENINVAAIETTLWSIEWALAEVVNHPAVQTKVRGEIKDVLGDDEPITESNIQQLPYLQAVIKETLRLHSPIPLLVPHMNLEEAKLGGYTIPRGSKVVVNAWWLANNPELWEKPEEFRPERFLDEDSGVDAATIGGKADFRFLPFGVGRRSCPGIILAMPILALIVGKLVRSFQMLPPPGVDKLDVSEKGGQFSLHIANHSVVAFHPIDSA

SEQ ID NO: 924 - protein, 491 aa, Sorghum bicolor
MAIKDEQQPLHILFLPFLAPGHLIPVADMAALFAARGVKCTILTTPVNAQVIRSAVDHANDASRGTEGALAIDIAVVPFPDVGLPPGVECGPALNSMEDREKFFHAVQLLRDPFVRFLAENRPDAVVSDSFFVWSADAAAEHGVPRIAFLGSSLFSRACNDTTVRNNPVEAAPDDPDALVLLPGLPHRVVLRRSQMFEPKKRPEHWASMQRGNAADQRSYGEVFNSFHELEPDYLEHYTTTLGRRAWLVGPVALASKDAATRGASNGLSPDANGCLQWLDTKQEGSVVYVSFGTLSHFSPPELRELARGLDMSGKNFVWVIGGGADTEESEWMPDGFAELMAGGDRGLIIRGWAPQMLILTHPAVGGFVTHCGWNSTLEAMSAGVPMVTWPRFADQFYNEKLVVELLKVGVGVGSTDYASKVETRRVIGGEVIAEAIVRVMGDGEDAVAIREKAKELAEKARRAVARGGSSYDDVGRLLDELMARRSSVNV

SEQ ID NO: 925 - protein, 491 aa, Sorghum bicolor
MAIKDEQKPLHILFFPFLAPGHLIPIADMAALFAARGVKCTILTTPVNAQVIRSAVDHANDAFRGTEGTLAIDIAVVPFPDVGLPPGVECGPALNSVDDHEKFFHAAQLLREPFDRFLAENRPDAVVADSFFEWAADAAAEHGVPRMAFLGSSLFSRTCIDSMLRYNPVEAAPDDPDALVLLPGLPHRVELRRSQMKEPKEQPEDWAFLQRVNAADLRSYGEVFNSFHDLERESLEHYTTTLGCRAWLVGPVALASKNHAARGAGDEPSPDADSCQQWLDTKAEGSVVYVSFGTLSHFSPPELRELASGLDMSGKNFVWVIGGGADTKESEWMPHGFAELMARGDRGFIIRGWAPQRLILAHPAMGGFVTHCGWNSTLEAVSAGVPMVTWPRFADQFYNEKLVVELLKVGVSVGSTDYASKLETRRLIGGEVIAEAIGRVMGDGEDAEAIREKAKELGEKARRAVAKGGSSYDDVGRLMDELIARRSSVNV

SEQ ID NO: 926 - protein, 474 aa, Zea mays
MAIKDEPQPLHILFFPFLAPGHLIPIADMAALFAARGVRCTILTTPVNAQLIRSAVDRANDASRGTEGALAIDIAVVPFPDVGLPPGVECAPALNTMDDREKFFHGAQLLREPFDRFLAENRPDAAVTDSFFDWSADAAAEHGRVYAAQQPRGGRPRRPDALVLLPGLPRRVELRRSQMMEPKKRPERWAFFQRMNAADQRSYGEVFNSFHELEPDFMEHYTTTLGRRAWLVGPVALASKDVATRGANNGLSPDAGACQQWLDAKPEGSVVYVSFGTLTHFSPPEMRELARGLDLSGKNFVWVVGGADTEESEWMPDGFAELVARGDRGFIIRGWAPQMLILTHPAVGGFVTHCGWNSTLEAVSAGVPMVTWPRYADQFYNEKLVVELLKVGVAVGSTDYASMLETRRAVIGGEVIAKAIGRVMGDGEDAEAIREMAKELGEKARRAVANGGSSYDDVGRLVDELMARRRSVKV

SEQ ID NO: 927 - protein, 490 aa, Panicum virgatum
MAIKGEQQPLRILFFPFLTPGHLIPAADMAALFAARGVKCTILTTPVNAGVIRLAVDRANEASRGTEDALSIDIAVVPFPDVGLPPGVESVPALNFDADGDKFFRAIQLLRESFDRFLTQNRTDAVVSDSFFDWSVDAAAEHGVPRLAFLGTSLFARACSDCTVRHNPVEAAPEDPDAPVLLPGLPHRVEMRRSQMMEPKKRPEHWAFHQRLNAADQRSYGEVFNSFHELEPEYVDHYTTTLGRRAWLVGPVAFASKDLATRGADDGLSPDADGCLRWLDTKPAGSVAYVSFGTLSRFSPPELRELARGLDLSGKDFVWVVGGADAEESEWMPDGFAELLARGERGLVIRGWAPQMLILNHAAVGGFVTHCGWNSTLEAVSAGVPMVTWPRYADQFYNEKLVVELLKVGVGVGSTDYASKLEARRVIGGDVVAEAIGRVMGDGEGAEAIRERARVLGEKARSAGEKGGSSYDDVGRLMDELMARRGLVNV

SEQ ID NO: 928 - protein, 486 aa, Pennisetum glaucum
MAVVDEQRPLHILFFPFLAPGHLIPAADMAAIFAARGVKCTILTTPVNAAVIRSAVDRANDAEGALAIDITVVPFPNVGLPPGVESGPALNSEADRAKFFHAIQLLREPFDRFLTKNRPDAVVSDSFFDWSVDAAAEHGVPRLAFLGSSLFARACSVSMLRHNPLEAAPNDPDALVLLPGLPHRVELKRSQMMDPKKRPDQWTFFQRVNDADQRGYGEVFNSFHDLEPDYLEHYTTTLGRRAWLVGPVALASKDVATRGAAANGLSPDADGILRWLDGKPAGSVVYVSFGTLSHFSPPELRELAHGLDMSGKNFVWVIGGGADTEKPEWMPDGFVELLAHGDRGLIIRGWAPQMLILNHAAVGGFVTHCGWNSTLEAVSAGVPMVTQWPRYADQFYNEKLVVELLKVGVGVGSTDYASKLEARRVIGGKVVAEAIGRVMGDSEEAEAIRERARVLGERARRAVEKGGSSYDDIARLMDELMARRGS

SEQ ID NO: 929 - protein, 484 aa, Setaria italica
MAIEGEQRPLHILFFPFLSPGHLIPAADMAALFATRGVKCTILTTPVNAAVIRSAVERANDAEGALAIDIAVVPFPDVGLPPGVESGPALNSEADRGKFFHAIQQLREPFDRFLAESRPDAVVSDSFFDWSVDAAAEHGVPRLAFLGSSLFARACSVSMLRHNPVEAAPDDPDASVLLPGLPHRVELRRSQMMDPKKRPDHWAFFQRVTDADQRGYGEVFNSFHDLEPDYLEHYTTTLGRRAWLVGPVALASKDVATRGAAANELSPDADGCLRWLEGKPSGSVVYVSFGTLSHFSPPELRELARGLNLSGKNFVWVIGGTDTEEQEWLPDGFAELLARGDRGLIIRGWAPQMLILNHSAVGVFVTHCGWNSTLEAVSAGVPMVTWPRYADQFYNEKVVVELLNVGVGVGSTDYASKLEARRVIGGEVVAEAIGRVMGNGEEGEAIRERARVLGEKARLAVEKGGSSYDDVGRLMDELMARRGL

SEQ ID NO: 930 - protein, 195 aa, Aegilops tauschii
MGAKLSCFSNHGGSLSQQPHQPAPVRVIAADGSLKELPASPRVTVSNVLGGSAASFFVCSSDALYFDQSPPALASGEVLQSGQIYFLLPAAPPPPPPPPPPPPPPPPPPRRWGREKPQRGRGRLSGGRKKVRVMPMHEEVEDGEDVLLNEKLNERTLGEFAVSPMSPEKIGVVAARSRLKMKLKRALSIIQEVAE

SEQ ID NO: 931 - protein, 249 aa, Secale cereale
MASYHRVHPVIVDGAPEQNKDKQPPPPSAAYGDRLPITAPAPGAAAPLRAPRRKRHSRCCRCVCCTLLVLIVLVVALGATAGILYAVFRPKIPTFRVERLTATRFDVNTTSMTVSDAFEVQVTAENPNRRIGVYYDGGWVAASFNGTELCRGAFPVLYQGHRSTVRPLITLEGETRLDSAVAAQLAQQRQAGFVPLTVTARVPIRIKFGALKLWTMTGKARCSLVVDSLEAGTRLRIRSNICTFKLKPN

SEQ ID NO: 932 - protein, 252 aa, Secale cereale
MASYHRVHPVIVDGAPPPAPEQNKDKQPAPASADYGDRLPITAPAPGAAAPLRAPRRKRHSRCCRCVCCTLLVLIVLVVALGATAGILYAVFRPKIPTFRVERLTATRFDVNTTSMTVSDAFEVQVTAENPNRRIGVYYDGGWVAASFNGTELCRGAFPALYQGHRSTVRPLITLEGETRLDSAVAAQLAQQRQAGFVPLTVTARVPIRIKFGALKLWTMTGKARCSLVVDSLEAGTRLRIRSNDLHLQAQA

SEQ ID NO: 933 - protein, 252 aa, Hordeum vulgare
MASYHRVHPVIVDGAPLPAPEQNKDKLPPPPNADYGDRLPITAPAPDAPAPLRAPRRKRHSRCCRCVCCTLLVVIVLVVALGATAGILYAVFRPKIPTFRVERLTATRFDVNTTSMTLRDAFEVQVTAENPNRRIGVYYDGGWVSASFNGTELCRGAFPALYQGHRSTVRPLITLEGETRLDSAVAAQLLQQRQAGFVPLTVIAHVPIRIKFGALKLWKMTGKARCRLVVDNLEAGRRLRIRSNSCSFKLKP

SEQ ID NO: 934 - protein, 78 aa, Secale cereale
MASAGRRPTVLLQIALFVVVAAVIVNSSVCLGADATAGSGAFDPNRPAVPSTGGAGKPYTGRGCLRNYGCYPPAAGQP

SEQ ID NO: 935 - protein, 78 aa, Secale cereale
MASASRRPTVLLQIALFVVVAAVIVNSSVCLGADATAGSGAFDPNRPAVPSTGGAGKPYTGRGCLRNYGCYPPAAGQP

SEQ ID NO: 936 - protein, 693 aa, Panicum virgatum
MDITEVTVVHHAALVLAALWAAASAGWAHPALFIVALLYIFAVNERYTMRLRRRLQYEERKCSNQRKLLSDAETVRWLNYAVEKIWSVCMERVVSQQFLLPIFPWFLQKFKPWTARKAVIQSLYLGRNPPMFTDIRVVRQSTDDDHLVLEIGMNFLSADDMDARMAVQLRKRVGFGITANMHITGMHVEGKVLVGVRFLRQWPFIGRVRVCFVEPPYFQMTVKPLFGHGLDVTELPGISGWLDRMLDVAFGQTLVEPNMLVINLEKFASESTENWFSVDEKPPIAHARVEILEGADMKPSDPNGLADPYVKGHLGPYRFQTKIHKKTLNPKWLEEFKIPITSWEALNLLSLQVRDKDHIFDDTLGDCSVSINKLRGGQRHDIWVSLKNIKTGRIHIAVTVIEEENEKVPNDEEVQGGTPKVGKACTPSSSFSSRTNNESESSDEIRKMSDEFEPVDIEGSQKPDVWVHRPGSDATSVWEPRKGRPRCQDSKIHRENDACSDSPRSSVSESNRSDSSTEEPTSGRSHRHLHKVKKGLGKLAGAVFHRSPKNGTDDEASPCVTPHPNIQPVGESRVSVTYVVDQDPGSNREGTRTKEQQHSSPEREELDSSSRRHLRKKAAHMVKHAGKTAHNLKSMFSKKDLDKSKEECQNEEVGDVAAMKIDGVAVDPPVPSNDVVELPESVADDGKDKGSET

SEQ ID NO: 937 - protein, 654 aa, Zea mays
MRLWRRIQYEERKCANQRKLLSDAETVRWLNYAVEKIWPVCMERVASQQFLLPIFPWFLEKFKPWTARKAVIQSLYLGRNPPMFTDIRVVNQSTDDDHLTVKQLKFTCQVLEIGMNFLSADDMDARMAVQLRKRLGFGITTNMHITGMHVEGKVLVGVRFLRQWPFIGRVRVCFVEPPYFQMTVKPLFGHGLDVTELPGISGWLDRMLDVAFGQTLVEPNMLVIDLEKFASESTGPFSFIHLAKSLMLRHAAVQGKHLLAADNWFSVDEKPPIAYARVEILEGADMKPSDPNGLADPYVKGQLGPYRFRTKIHKKTLDPKWLEEFKIPITSWEALNLLHLQVRDKDPIFDDALGDCSISINKLRGGIRHDIWIALKNIKTGRIHVAVTVLEEENEKVSNDEEEQCGIHKVDKASTPRSSFSSRTNHESECSDEFRKMSDEFEPVDIEGSEKPDVWVHRPGSYVTSTWEPRKGRPRCQDSRIHRENDSCSDSPRSSVSESHRSDSSTEEPTSSKSHRHLQKVKKGLGKLAGAVLHRSPKENDDEASPCVTPHQNIRPVGESRVSVTYVVDQDPAGVDGSGSRRDDHQQSPEREELDSPSKRHLRKKAVHMVKHAGKTAHNLKSMFSKKGLDKSKEEHRSDEECDEEGDVVAARRV

SEQ ID NO: 938 - protein, 691 aa, Setaria italica
MDITEVTVVHHAALVLAALWAAASAGWAHPALFLVALLYIFAVNERYTMRLRRRLQYEERKCSNQRKLLSDAETVRWLNYAVEKIWPVCMERVASQQFLLPIFPWFLEKFKPWTARKAVIQSLYLGRNPPMFTDIRVVRQSTDDDHLVLEIGMNFLAADDMDARMAVQLRKRVGFGITANMHITGMHVEGKVLVGVRFLQQWPFIGRVRVCFVEPPYFQMTVKPLFGHGLDVTELPGISGWLDRMLDVAFGQTLVEPNMLVIDLEKFASEPTENWFSVDEKPPIAHARVEILEGADMKPSDPNGLADPYVKGHLGPYHFQTKIHKKTLNPKWLEEFKIPITSWEALNLLSLQVRDKDPIFDDTLGDCSISINKLRGGQRHDIWISLKNIKTGRIHIAVTVLEEENEKVLNDEEEQGGTPKVGKASTPRSSFSSRTNNESESSEEFQKMSDEFEPVDIEGSEKPDVWVHRPGSDVTSTWEPRKGRPRCQDSKIQRENDACSDSPRSSVSESQRSDSSTEEPTGGRSHRHLRKVKKGLGKLAGAVFHRSPKNETDDDASPCVTPHPNIQPVGESRVSVTYVVDQDPGSNRKGTVTDEEQHSSPEREEPNSPTKRHLRKKAAHMVKHAGKTTAHNLKSMFSRKGLDKSKEECQNDEEGDVVAMKIDGMAADPPVPSNDAVDAPESVADGKDKVQ

SEQ ID NO: 939 - protein, 691 aa, Pennisetum glaucum
MDITEVTVVHHAALVLAALWAAASAGWAHPALFLVALLYIFAVNERYIMRLRRRLQYEERKCSNQRKLLSDAETVRWLNYAVQKIWPVCMERIASQQFLLPIFPWFLEKFKPWTARKAVIQSLYLGRNPPMFTDIRVVRQSTDDDHLVLEIGMNFLAADDMDARMAVQLRKRVGFGITANMHITGMHVEGKVLVGVRFLRQWPFIGRVRVCFVEPPYFQMTVKPLFGHGLDVTELPGISGWLDRMLDVAFGQTLVEPNMLVIDLEKFASEPTENWFSVDEKPPIAHAQVEILEGADMKPSDPNGLADPYVKGHLGPYRFQTKIHKKTLNPKWLEEFRIPITSWEALNLLSLQVRDKDPIFDDTLGDCSISINKLRGGQRHDIWISLKNIKTGRIHIAVTVLEEENEKILNYDEEQGGTPKVGKASTPRSSFSWRTNNESESSEEFRKMSDEFEPVDIEGSEKPDVWVHRPGSDVTSTWEPRKGRPRCQDSKIQRENDACSDSPRSSLSGSHRSDSSTEEPTRGRSHRHLRKVKKGLDKLAGAVFHRSPKNEIDDDVFPCVTPHPNIRPVGDSRVSVRYVVDQDPGSNRKGTVTDEEQHSSPEREEPNSPTKRHLRRKAAHMVKHAGKTTAHNLKSMFSRKGLDKSNEECQDDEEGDVVAIKVDTMESDPPVPSNDAVDAPESVADGKDKMQ

SEQ ID NO: 940 - protein, 157 aa, Zea mays
MGKGVLEVHLVDAKGLSGNDFLGKLDPYVIMQYRSQERKSSVARDQGRNPCWNEVFKFQINSAAANVQHKLILRIMDHDNFSSDDFLGEATIDVTDIVSLGAERGTYHLNAAKHNVVLADKTYHGEIKVAITFTSTQTQVQEDGGAIGGWRHSSFNQ

SEQ ID NO: 941 - protein, 143 aa, Zea mays
MMQVFVKTLVGKTITLEVECSDTVENVKAMIQGKEGIPPEEQRLVFAGKQLDDDGRTLADYGVQKESTLHLELRLRGGSRGGYPMGIPPSLRELAQKYNENKMVCRKCYARLPPRATNCRKKKCGHSNELRSKKRFMSKIGGK

SEQ ID NO: 942 - protein, 671 aa, Sorghum bicolor
MDITEVTVVHHAALVLAALWAAAAAGWAHPALFLVALLYIFAVNQRYTMRLWRRIQYEERKCANQRKLLSDAETVRWLNYAVEKIWPVCMERVASQQFLLPIFPWFLEKFKPWTARKAVIQSLYLGRNPPMFTDIRVVNQSTDDDHLVLEIGMNFLSADDMDARMAVQLRKRLGFGITTNMHITGMHVEGKVLVGVRFLRQWPFIGRVRVCFVEPPYFQMTVKPLFGHGLDVTELPGISGWLDRMLDVAFGQTLVEPNMLVIDLEKFASESTENWFSVDEKPPIAYARVEILEGADMKPSDPNGLADPYVKGHLGPYRFHTKIHKKTLNPKWLEEFKIPITSWEALNLLSLQVRDKDPIFDDTLGDCSISINKLRGGKRHDLWIALKNIKTGKIHISVTVLEEENEKVPNDEEEQCGIHKVDEASTPRSSFSSRTNHGSESSDEFQKMSDEFEPVDIEGSEKPDVWVHRPGSDVTSAWEPRKGRPRCQDSKIHRENDACSDSPRSSASESHRSDSSTEEATSSKSHRHLHKVKKGLGKLAGAVLHRSPRKENDDEASPCVTPHPNIRPVGESRVSVTYLVDQDPGVNRSGSRPDQQQSPEREELDSPNKRHLRKKAVHMVKHAGKTAHNLKSMFSKKGLDKSKEEEHSDEEGDVVAMEKTGMEVDPSLPSI

SEQ ID NO: 943 - protein, 671 aa, Sorghum bicolor
MDITEVTVVHHAALVLAALWAAAAAGWAHPALFLVALLYIFAVNQRYTMRLWRRIQYEERKCANQRKLLSDAETVRWLNYAVEKIWPVCMERVASQQFLLPIFPWFLEKFKPWTARKAVIQSLYLGRNPPMFTDIRVVNQSTDDDHLVLEIGMNFLSADDMDARMAVQLRKRLGFGITTNMHITGMHVEGKVLVGVRFLRQWPFIGRVRVCFVEPPYFQMTVKPLFGHGLDVTELPGISGWLDRMLDVAFGQTLVEPNMLVIDLEKFASESTENWFSVDEKPPIAYARVEILEGADMKPSDPNGLADPYVKGHLGPYRFHTKIHKKTLNPKWLEEFKIPITSWEALNLLSLQVRDKDPIFDDTLGDCSISINKLRGGKRHDLWIALKNIKTGKIHISVTVLEEENEKVPNDEEEQCGIHKVDEASTPRSSFSSRTNHGSESSDEFQKMSDEFEPVDIEGSEKPDVWVHRPGSDVTSAWEPRKGRPRCQDSKIHRENDACSDSPRSSASESHRSDSSTEEATGSKSHRHLHKVKKGLGKLAGAVLHRSPRKENDDEASPCVTPHPNIRPVGESRVSVTYLVDQDPGVNRSGSRPDQQQSPEREELDSPNKRHLRKKAVHMVKHAGKTAHNLKSMFSKKGLDKSKEEEHSDEEGDVVAMEKTGMEVDPSLPSI

SEQ ID NO: 944 - protein, 91 aa, Zea mays
MAGAAKASWMVAMSVGAVEALKDQGGLCRWNYALRSVHRTAKANVRSSLAAQRDKELAPAAAAAESKRRPGKAAAEEGMRTVMYLSCWGPN

SEQ ID NO: 945 - protein, 85 aa, Saccharum officinarum
MAGAAKASWMVAMSVGAVEALKDQTGLCRWNYALRSVHRTAKANVRSSFAAQAKKLAPPAAEKRRADKAAEGMRTVMYLSCWGPN

SEQ ID NO: 946 - protein, 89 aa, Saccharum officinarum
MAGAAKASWMVAMSVGAVEALKDQAGLCRWNYALRSIHRTAKANVRSSLAAQAMNLAPPAAAATEKRRADKASEEGMRTVMYLSCWGPN

SEQ ID NO: 947 - protein, 82 aa, Saccharum officinarum
MAAAAKASWMVAMSVGAVEALKDQAGLCRWNYALRSVHRAAKANVRSSLVQAKKLAPAEKRRADKAEEGMRTVMYLSCWGPN

SEQ ID NO: 948 - protein, 155 aa, Setaria italica
MGKGVLEVHLVDAKGLYGNDFLGKLDPFVIVQYRSQERKSSVARDQGRNPRWNEVFKFQINSAASNAQHKLILRILDHDHFSSDDSLGEATIDVTGIISLGAERGTYTQSAAKHSVVLADNTFHGEIKVGFTFTATQVQEDGEEIGGWRYSSFNQ

SEQ ID NO: 949 - protein, 155 aa, Panicum virgatum
MGKGVLEVHLVDARGLSGSDFLGKIDPYVIVQYRSQERKSSVARDQGRNPCWNEVFKFQINSSASSAQHKLILRIMDHDHFSSDDFLGKATIDVTDIISLGAERGSYHLNAGKHNVVLADSTYHGEIKVGITFTAAQVEEDDEDFGGWRRRSSNA

SEQ ID NO: 950 - protein, 156 aa, Panicum virgatum
MGKGVLEVHLVDARGLSGTDFLAGKIDPYVIVQYRSQECKSSVARDQGRNPCWNEVFKFQINSSASSAQHKLILRIMDHDHFSSDDFLGEATIDVTDIISLGAEHGSYHLNAAKHSVVLADSTYHGEIKVGITFTAAKVEEDDEDFGGWKHRNFNE

SEQ ID NO: 951 - protein, 417 aa, Panicum virgatum
MGNAAVAIISSIAGTATVVVVIALIRRCRVVRKKMKKKIGKKIIKEIERMNREAQACKALEDVVIEIGPVEKFLNDILNEKPMRFSSEQLAACTRNYSSELGSGGFGVVYKGDLPNGLPVAVKVLKVSMNKKVQEAFMAEIGTIGRTYHVHLVRLYGFCFDRDTKALVYEFLEKGSLEKYLYGGDEEGTAPRLEWRTLHSIAVGTAKGIRYLHEECQQRIVHYDIKPANILLTGDFTPKVADFGLARLGERENTHMSLTGGGRGTPGYAAPELWMALPATEKCDVYSFGMVLFEILGRRRNFDPCEGESKEWYPRWVWEKYEQGELECVVSGDGIGEADRDKAEMMCKVALWCVQFQPAARPTMSSVVRMLEGEMAIVPPVNPFHYVMDSSSGSTSSGLWSSGTYQSSRDTTGRNSQ

SEQ ID NO: 952 - protein, 414 aa, Zea mays
MGNALAIITTIIVSKRMKKKIVKKVLEEIEKKNRETQASNNAVEDAVIEVGPVETFLNQILNEKPMRFSSEQLAACTRNYSSELGSGGYGTVYKGELPNGLLVAVKVLKVSMNKKVQEAFMAEIGTIGRTYHVHLVRLYGFCFDANTKALVYEYLEKGSLEKYLYYGDVECSTSTGKRLEWGTLHGIAVGTAKGIRYLHEECQQRIVHYDIKPANILLTADDTPKVADFGLARLGEREDTHMSLTGGGRGTPGYAAPELWMALPASEKCDVYSFGMVLFEILGQRRNYDPCRGESREWFPRWVWERYEQGEIEYVVSCDGIGEADMEKAEIMCKVALWCVQFQPAARPTMSSVVRMLEGEMPIVPPVNPFHYVMDSSSGSTSSGLWSDTYQSSRETIGIAIDSELSVSPIAKST

SEQ ID NO: 953 - protein, 401 aa, Sorghum bicolor
MGNAVAIISTIVVNKKMKKKIVEKVLEEMKKNREMQVSNNVEDVVIEVGPVETFLNQILNEKPMRFSSQQLAACTRNYSSELGSGGYGVVYKGELPNGLPVAVKVLKVSMNKRVQEAFMAEIGTIGRTYHVHLVRLYGFCFDANTKALVYEYLENGSLEKYLYGDVEGSTATRLEWEALHGIAVGTAKGIRYLHEECQQRIVHYDIKPANILLTADYTPKVTDFGLARLGERENTHMSLTGGGRGTPGYAAPELWLALPASEKCDVYSFGMVLFEILGRRRNFDPCHGESKEWFPRWVWEKYEQGEIDCVVSCDGVVGEADRQKAEMMCKVALWCVQFQPAARPTMSSVVRMLEGEMAIVPPANPFHYVMDNNIGSTNSGFWSDTYQSSRETWQRQRAIGN

SEQ ID NO: 954 - protein, 448 aa, Sorghum bicolor
MGNAAVAIASSVGGTATVVVMIVLIRRCRAVRKKIKKKIVKKVLEELDRKNRELQLACDPAEDVVIEIGPVEKFLNEILSEKPMRFSSEQLAVYTKNYSCELGSGGYGVVYKGELPNGLLVAAKVLKVSMNRKVQEAFMAEIGTIGRTYHVHLVRLYGFCFDANTKALVYEYLENGSLEKYLYGDEGCTTTRLEWGTLHSIAVGTAKGIRYLHEECQQRIVHYDIKPANILLTADYTPKVADFGLARLGERENTHMSLTGGGRGTPGYAAPELWMALPASEKCDVYSFGMVLFEILGRRRNYDPCRGESKEWFPRWAWEKYEQGEIEDVVCCDGIVGEADRNKAEMMCKVALWCVQFQPSARPTMSSVVRMLEGEMAIVPPVNPFHYIMDISSGSTSSGMWSGTYQSSRDTTARDSELSIISSAAKSTGAMVEDVERTLASVLRKQSL

SEQ ID NO: 955 - protein, 328 aa, Secale cereale
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLQQQGGEETTMMEPKEENTASDMVVTSHSHSQSQSHSHSWGEARTPESEIVDNDPSLFQQAAAFQTQSPAAAAAHQEMMATLMVPKKEAADEAGRNDLFVDLSYDDIQSMYNGLDMMPPGDDLLYSSLFASPRVRGSQPGAGGMPAPF

SEQ ID NO: 956 - protein, 328 aa, Secale cereale
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLQQQGGEETTMMEPKEENTASDMVVTSHSHSQSQSHSHSWGEARTPESEIVDNDPSLFQQAAAFQTQSPAAAAAHQEMMATLMVPKKEAADEAGRNDLFVDLSYDDIQSMYNGLDMMPPGDDLLYSSLFASPRVRGGQPGAGGMPAPF

SEQ ID NO: 957 - protein, 327 aa, Triticum aestivum
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLQQQGGEEMMVEPKAENTASDMVVTSHSHSQSQSHSHSWGEARTPESEIVDNDPSLFQQAAAFQAQSPAAAAAHQEMMATLMVPKKEAADEAGRNDLFVDLSYDDIQSMYNGLDMMPPGDDLLYSSLFASPRVRGSQPGAGGMPAPF

SEQ ID NO: 958 - protein, 328 aa, Secale cereale
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLQQQGGEETTMMEPKEENTASDMVVTSQSQSQSQSHSHSWGEARTPESEIVDNDPSLFQQAAAFQTQSPAAAAAHQEMMATLMVPKKEAADEAGRNDLFVDLSYDDIQSMYNGLDMMPPGDDLLYSSLFASPRVRGSQPGAGGMPAPF

SEQ ID NO: 959 - protein, 329 aa, Aegilops tauschii
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLQQQGGEEMMVEPKEEHAASDMVVTSHSHSHSQSQSHSHSWGEARTPESEIVDNDPSLFQQAAAFQAQSPAAAAAHQEMMATLMVPKKEAADEAGRNDLFVDLSYDDIQSMYNGLDMMPPGDDLLYSSLFASPRVRGSQPGAGGMPAPF

SEQ ID NO: 960 - protein, 318 aa, Avena sativa
MGMAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRASASAKKGSLRLDDWVLCRLYNKKNEWEKMQQQGEQKVEPKAEEASAASDMVTSQSHSHSWGEARTPESEIVDTDPALFQQAAAAGFQSPVAAAAHQEMMATLMVPKKEAADEGRNDLFVDLSYDDIQSMYSGLDVMPPGDDLLYSSLFASPRLRGSQPGAGGGMPGPF

SEQ ID NO: 961 - protein, 318 aa, Avena sativa
MGMAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRASASAKKGSLRLDDWVLCRLYNKKNEWEKMQQQGEQKVEPKAEEASAASDMVTSQSHSHSWGEARTPESEIVDTDPALFQQAAAAGFQSPVAAAAHQEMMATLMVPKKEAADEGRNDLFVDLSYDDIQSMYSGLDVMPPGDDLLYSSLFASPRLRGSQPGAAGGMPGPF

SEQ ID NO: 962 - protein, 319 aa, Avena sativa
MGMAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRASASAKKGSLRLDDWVLCRLYNKKNEWEKMQQQGEQKVEPKAEEASAASDMVTSQSHSHSWGEARTPESEIVDTDPALFQQAAAAGFQSPVAAAAHQEMMATLMVPKKEAADEGRNDLFVDLSYDDIQSMYSGLDVMPPGDDLLYSSLFASPRLRGSQPGAAAGGMPGPF

SEQ ID NO: 963 - protein, 319 aa, Avena sativa
MGMAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRASASAKKGSLRLDDWVLCRLYNKKNEWEKMQQQGEQKVEPKAEEASAASDMVTSQSHSHSWGEARTPESEIVDTDPALFQQAAAAGFQSPVAAAAHQEMMATLMVPKKEAADEGRNDLFVDLSYDDIQSMYSGLDVMPPGDDLLYSSLFASPRLRGSQPGAGAGGMPGPF

SEQ ID NO: 964 - protein, 317 aa, Avena sativa
MGMAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRASAGAKKGSLRLDDWVLCRLYNKKNEWEKMQQGEQKVEPKAEEASAASDMVTSQSHSHSWGEARTPESEIVDNDPALFQQAAAAAGFQSPVAAAHQEMMATLMVPKKEAADEGRNDLFVDLSYDDIQSMYSGLDVMPPGDDLLYSSLFASPRLRGTQPGAGGGMPGPF

SEQ ID NO: 965 - protein, 426 aa, Zea mays
MVNAVATIISTVASTATVVVIVALIRRCRVVRKKMKKKIVKKVLEEIEKKNREMQASNAVEDVAIEVGPVETFLNQILNEKPMRFSSEQLAACTRNYSSELGSGGYGVVYKGELPNGLLVAAKVLKVSSMNRKVQEAFMAEIGTIGRTYHVHLVRLYGFCFDASTKALVYEFLENGSLEKYLYGGDEGSTTSTRLEWGTLHGIAVGTAKGIRYLHEECQQRIVHYDIKPANILLTADYTPKVADFGLARLGERENTHMSLTGGGRGTPGYAAPELWMAMPASEKCDVYSFGMVLFEILGRRRNYDPCLEGESKEWFPRWVWEKYEQGEIEHVVSCSCDGIVGGADREKAEIMCKVALWCVQFQPSARPTMSSVVRMLEGEMPIVPPVNPFHYLMESGGGSTSSGLWSGTYQSSSRDTAGAELSPVG

SEQ ID NO: 966 - protein, 108 aa, Zea mays
MRREGRQHGWVFTVDPSLVDAEGKCRSRAVQVEGAAAANGGFVRASRKPTNHSKPAVGRAYKSLIGKGEAGSGKQGRHKFKHDEVKMYSLYLEGAHDAYADAMLEFDS

SEQ ID NO: 967 - protein, 330 aa, Hordeum vulgare
MGMPAARRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLQQQQGEGETMMEPKAEENTASDMVVTSHSHSQSQSHSHSWGEARTPESEIVDNDPSLFHQAQATAFQTQSPAAAAAHQEMMATLMVPKKEAADEGRNDLFVDLSYDDIQSMYNGLDMMPPGDDLLYSSFFASPRVRGSQPGSGGMPAPF

SEQ ID NO: 968 - protein, 427 aa, Zea mays
MVNAVATIISTVASTATVVVIIALIRRCRVVRKKMKKKIVKKVLEEIEKKNSEMQGSNAVEDVAIEVGPVETFLNQILNEKPMRFSSEQLAACTRNYSSELGSGGYGVVYKGELPNGLLVAAKVLKVSSMNRKVQEAFMAEIGTIGRTYHVHLVRLYGFCFDASTKALVYEFLENGSLEKYLYGGDEGSTTSMRLEWGTLHGIAVGTAKGIRYLHEECQQRIVHYDIKPANILLTADYTPKVADFGLARLGERENTHMSLTTGGGRGTPGYAAPELWMALPASEKCDVYSFGMVLFEILGRRRNYDPCLEGESKEWFPRWVWEKYEQGEIEHVVSCSCDGIVGGADREKAEIMCKVALWCVQFQPSARPTMSSVVRMLEGEMPIVPPVNPFHYLMESGGGSTISGLWSGTYQSSSRDTAGAELSPVG

SEQ ID NO: 969 - protein, 155 aa, Saccharum officinarum
MGKGVLEVHLVDAKGLSGNDFLGKLDPYVIVQYRSQERKSSVARDQGRNPCWNEVFKFQINSAAANAQHKLILRIMDHDNFSSDDFLGEATIDVTDIVSLSAERGTYHLNAAKHNVVLADKTYQGEIKVGITFTATQVQEDGGAIGGWRHSSFNQ

SEQ ID NO: 970 - protein, 155 aa, Sorghum bicolor
MGKGVLEVHLVDAKGLSGSDFLGKLDPYVIVQYRSQERKSSVARDQGRNPCWNEVFKFQINSAAANAQHKLILRIMDHDNFSSDDFLGEATIDVTDIVGLGTERGTYHLNAAKHNVVLPDKTYHGEIKVGITFTATQVQEDGGAIGGWRHSSFNQ

SEQ ID NO: 971 - protein, 143 aa, Sorghum bicolor
MQIFVKTLTGKTITLEVESSDTIDNVKAKIQDKEGIPPDQQRLIFAGKQLDDGRTLADYNIQKESTLHLVLRLRGGSRGGYPTTISPSLRELAQKYNENKMVCRKCYARLPPRATNCRKKKCGHTNALRSKKRFMSKIGGTNK

SEQ ID NO: 972 - protein, 141 aa, Setaria italica
MQIFVKTLTGKTITLEVESSDTIDNVKAKIQDKEGIPPDQQRLIFAGKQLEDGRTLADYNIQKESTLHLVLRLRGGSRGGYPTGIEPSLRELAQKYNENKRVCRKCYARLPLRATNCRKKKCGHTNELRSKKRFMSKNGGA

SEQ ID NO: 973 - protein, 446 aa, Zea mays
MGNAAVAIISSVSATATVVVMIALIRRCRVVRKKIKKKIVKKVLEEIERKNRVGAACDALEDVVIEIGPVEKFLNEILNEKPMRFSSEQLAACTKNYSSELGSGGYGVVYKGELPNGLLVAVKVLKVSMNKKVQEAFMAEIGTIGRTYHVHLVRLYGFCFDADTKALVYEFLEKGSLEKYLYCDEGSTATRLEWATLHGIAVGTAKGIRYLHEECQQRIVHYDIKPANILLTADYTPKVADFGLARLGERENTHMSLTGGGRGTPGYAAPELWMALPASEKCDVYSFGMVLFEILGRRRNYDPCQGESKEWFPRWVWERYAQGEIEDVVACDGIVGDADREKAEMMCKVALWCVQFQPSARPTMSSVVRMLEGEMAIVPPVNPFHYVMESSSASTSSGLWSGTYQSSRDTTARESELSASPAAKSTDAMIEDVERAYASVLAKQSL

SEQ ID NO: 974 - protein, 108 aa, Sorghum bicolor
MRREGRQHGWVFTVDPSLVDAEGKQCRSRAVQVDGAAAANGGFVRAPRKPTNHTKPAVGRAYKALIGKGEAGSGRGRHKFKHDEAKMYHLYLEGADDAYADAMLEFDW

SEQ ID NO: 975 - protein, 324 aa, Pseudoroegneria spicata
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLHQEQDGEMMVEPKAENTASDMVVTSHSHSQSQSHSHSWGEARTPESEIVDNDPSLFQKAAAFQTQSPAAAHQEMMATLMVPKKEAADEGRNDLFVDLSYDDIQSMYNGFDMMPPGDDLLYSTLFPSPRVRGSQPGAGGMPAPF

SEQ ID NO: 976 - protein, 319 aa, Avena sativa
MGMAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRASASAKKGSLRLDDWVLCRLYNKKNEWEKMQQQGEQKVEPKAEEASAASDMVTSQSHSHSWGEARTPESEIVDTDPALFQQQAAAAGFQSPVAAAAHQEMMATLMVPKKEAADEGRNDLFVDLSYDDIQSMYSGLDVMPPGDDLLYSSLFASPRLRGSQPGAAGGMPGPF

SEQ ID NO: 977 - protein, 298 aa, Avena sativa
MGMAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRASASAKKGSLRLDDWVLCRLYNKKNEWEKMQQQGEQKVEPKAEEASAASDMVTSQSHSHSWGEARTPESEIVDTDPALFQQQAAAAGFQSPVAAAAHQEMMATLMVPKKEAADEGRNDLFVDLSYDDIQSMYSGLDVMPPGDDLLYSSL

SEQ ID NO: 978 - DNA, 33 bp, Artificial Sequence
  Primer
aaaaagaattcaacggcgtgtagctcagtttac

SEQ ID NO: 979 - DNA, 33 bp, Artificial Sequence
  Primer
aaaaagaattcaactacatccaacccgaaacac

SEQ ID NO: 980 - DNA, 33 bp, Artificial Sequence
  Primer
aaaaagaattcaactcttcccaccaagctatcc

SEQ ID NO: 981 - DNA, 34 bp, Artificial Sequence
  Primer
aaaaagaattcaacttgtcttaccgatgatgcag

SEQ ID NO: 982 - DNA, 32 bp, Artificial Sequence
  Primer
aaaaagaattcaataaattgggaaccgcagtg

SEQ ID NO: 983 - DNA, 33 bp, Artificial Sequence
  Primer
aaaaagaattcaatttgatcgaatcgtgtgacc

SEQ ID NO: 984 - DNA, 33 bp, Artificial Sequence
  Primer
aaaaagaattcacagcaacgaatcacatggtag

SEQ ID NO: 985 - DNA, 34 bp, Artificial Sequence
  Primer
aaaaagaattcaccatgggacatattcacatacc

SEQ ID NO: 986 - DNA, 32 bp, Artificial Sequence
  Primer
aaaaagaattcacgtactccactccatccatc

SEQ ID NO: 987 - DNA, 33 bp, Artificial Sequence
  Primer
aaaaagaattcatatacgtgccggtaaatggtg

SEQ ID NO: 988 - DNA, 33 bp, Artificial Sequence
  Primer
aaaaagaattcatcacgacattctcgtcacaac

SEQ ID NO: 989 - DNA, 33 bp, Artificial Sequence
  Primer
aaaaagaattcatctctacacctcctggcaatg

SEQ ID NO: 990 - DNA, 33 bp, Artificial Sequence
  Primer
aaaaagaattcatctgttgaaagcagccctatg

SEQ ID NO: 991 - DNA, 33 bp, Artificial Sequence
  Primer
aaaaagaattcatgaggccaagcgagtattaac

SEQ ID NO: 992 - DNA, 33 bp, Artificial Sequence
  Primer
aaaaagaattcatggcgtgaatagctcctacag

SEQ ID NO: 993 - DNA, 33 bp, Artificial Sequence
  Primer
aaaaagaattcattgggaaggtagtgtagcagc

SEQ ID NO: 994 - DNA, 33 bp, Artificial Sequence
  Primer
aaaaagaattccaaatcataggcttccatgttg

SEQ ID NO: 995 - DNA, 33 bp, Artificial Sequence
  Primer
aaaaagaattccaacatgcccagtaacagagtg

SEQ ID NO: 996 - DNA, 33 bp, Artificial Sequence
  Primer
aaaaagaattccaactaggagctaaccagccag

SEQ ID NO: 997 - DNA, 33 bp, Artificial Sequence
  Primer
aaaaagaattccaacttcagctctgttcgtgtc

SEQ ID NO: 998 - DNA, 33 bp, Artificial Sequence
  Primer
aaaaagaattccaattgcagcacctattgaagg

SEQ ID NO: 999 - DNA, 32 bp, Artificial Sequence
  Primer
aaaaagaattccacacttcttccttgagctgc

SEQ ID NO: 1000 - DNA, 33 bp, Artificial Sequence
  Primer
aaaaagaattccacaggcctgaaacatacagtg

SEQ ID NO: 1001 - DNA, 32 bp, Artificial Sequence
  Primer
aaaaagaattccaccacgtactccactccatc

SEQ ID NO: 1002 - DNA, 33 bp, Artificial Sequence
  Primer
aaaaagaattccagccagtgacttacacactcc

SEQ ID NO: 1003 - DNA, 34 bp, Artificial Sequence
  Primer
aaaaagaattccattgtcctatgctttgacaacc

SEQ ID NO: 1004 - DNA, 33 bp, Artificial Sequence
  Primer
aaaaagaattcccaagcaaccaaagaacttgag

SEQ ID NO: 1005 - DNA, 34 bp, Artificial Sequence
  Primer
aaaaagaattcccatgacgattccatacatatcc

SEQ ID NO: 1006 - DNA, 33 bp, Artificial Sequence
  Primer
aaaaagaattccggtcacaatcacaactcaaag

SEQ ID NO: 1007 - DNA, 36 bp, Artificial Sequence
  Primer
aaaaagaattcctaaataactcgcatagacacgtcg

SEQ ID NO: 1008 - DNA, 36 bp, Artificial Sequence
  Primer
aaaaagaattcctaaatttgttggacggacacagag

SEQ ID NO: 1009 - DNA, 35 bp, Artificial Sequence
  Primer
aaaaagaattcctaacagaaacaccgtgcaaagac

SEQ ID NO: 1010 - DNA, 33 bp, Artificial Sequence
  Primer
aaaaagaattcctaagcagcaggttggtctttg

SEQ ID NO: 1011 - DNA, 34 bp, Artificial Sequence
  Primer
aaaaagaattcctaagcaggttggtctttggtcc

SEQ ID NO: 1012 - DNA, 32 bp, Artificial Sequence
  Primer
aaaaagaattcctagctcaacagcacgaggac

SEQ ID NO: 1013 - DNA, 33 bp, Artificial Sequence
  Primer
aaaaagaattcctagtagcacgcacaggatcac

SEQ ID NO: 1014 - DNA, 33 bp, Artificial Sequence
  Primer
aaaaagaattcctatagctcgaccgttccaaag

SEQ ID NO: 1015 - DNA, 33 bp, Artificial Sequence
  Primer
aaaaagaattcctccatgcatctgaaatgctac

SEQ ID NO: 1016 - DNA, 33 bp, Artificial Sequence
  Primer
aaaaagaattcctcctttcattcggtcacaatc

SEQ ID NO: 1017 - DNA, 33 bp, Artificial Sequence
  Primer
aaaaagaattccttgcaaacattacagccagtg

SEQ ID NO: 1018 - DNA, 33 bp, Artificial Sequence
  Primer
aaaaagaattcgacaccttcaaagagaggcaac

SEQ ID NO: 1019 - DNA, 33 bp, Artificial Sequence
  Primer
aaaaagaattcgcaatgaactgaacagtgaacc

SEQ ID NO: 1020 - DNA, 33 bp, Artificial Sequence
  Primer
aaaaagaattcgtttgctttcatttctgccaac

SEQ ID NO: 1021 - DNA, 33 bp, Artificial Sequence
  Primer
aaaaagaattctacacaaccacacggatctctc

SEQ ID NO: 1022 - DNA, 33 bp, Artificial Sequence
  Primer
aaaaagaattctacatcagggctagacccaaac

SEQ ID NO: 1023 - DNA, 33 bp, Artificial Sequence
  Primer
aaaaagaattctacgacacatgcacataccctc

SEQ ID NO: 1024 - DNA, 33 bp, Artificial Sequence
  Primer
aaaaagaattctaggcctaagccaactgatgtc

SEQ ID NO: 1025 - DNA, 33 bp, Artificial Sequence
  Primer
aaaaagaattctatccaaacgtctcagatgacc

SEQ ID NO: 1026 - DNA, 33 bp, Artificial Sequence
  Primer
aaaaagaattctatctgtgtgtagcactgcctg

SEQ ID NO: 1027 - DNA, 33 bp, Artificial Sequence
  Primer
aaaaagaattctcaccagtatacgctatggacg

SEQ ID NO: 1028 - DNA, 34 bp, Artificial Sequence
  Primer
aaaaagaattctcacttgttctgcatacatcagg

SEQ ID NO: 1029 - DNA, 33 bp, Artificial Sequence
  Primer
aaaaagaattctctgctttactccagacccaag

SEQ ID NO: 1030 - DNA, 33 bp, Artificial Sequence
  Primer
aaaaagaattctgatccactaatgacggtatgg

SEQ ID NO: 1031 - DNA, 33 bp, Artificial Sequence
  Primer
aaaaagaattctgttcctatacggagcaacacc

SEQ ID NO: 1032 - DNA, 33 bp, Artificial Sequence
  Primer
aaaaagaattcttcatgttgtggtgttgttacg

SEQ ID NO: 1033 - DNA, 31 bp, Artificial Sequence
  Primer
aaaaggcctatatggggaagaactcatcagg

SEQ ID NO: 1034 - DNA, 30 bp, Artificial Sequence
  Primer
aaaaggcctatctgccgatcgatctcaatc

SEQ ID NO: 1035 - DNA, 31 bp, Artificial Sequence
  Primer
aaaaggcctcacatgctcataccaaggtcac

SEQ ID NO: 1036 - DNA, 36 bp, Artificial Sequence
  Primer
aaaaggcctctaaacaagagaatcccttaattggtg

SEQ ID NO: 1037 - DNA, 32 bp, Artificial Sequence
  Primer
aaaaggcctctacccgggtttacatttgtgac

SEQ ID NO: 1038 - DNA, 37 bp, Artificial Sequence
  Primer
aaaaggcctctagagaccaggacgtagtataacgaag

SEQ ID NO: 1039 - DNA, 36 bp, Artificial Sequence
  Primer
aaaaggcctctagttccaagcaatctttagaagacg

SEQ ID NO: 1040 - DNA, 35 bp, Artificial Sequence
  Primer
aaaaggcctctatatatacgttcgcagtccatctg

SEQ ID NO: 1041 - DNA, 31 bp, Artificial Sequence
  Primer
aaaaggcctgttcacgttgggacctattttc

SEQ ID NO: 1042 - DNA, 31 bp, Artificial Sequence
  Primer
aaaaggccttctccctccctcttcagttagg

SEQ ID NO: 1043 - DNA, 34 bp, Artificial Sequence
  Primer
aaaaggccttggaagatccctatttcattattgc

SEQ ID NO: 1044 - DNA, 31 bp, Artificial Sequence
  Primer
aaacccgggagaagaggcaacccattcattc

SEQ ID NO: 1045 - DNA, 30 bp, Artificial Sequence
  Primer
aaacccgggagacgcttgtgaatcctggtc

SEQ ID NO: 1046 - DNA, 30 bp, Artificial Sequence
  Primer
aaacccgggagaggcgtctctggttattgc

SEQ ID NO: 1047 - DNA, 30 bp, Artificial Sequence
  Primer
aaacccgggagctgtatgttcgagcccttc

SEQ ID NO: 1048 - DNA, 30 bp, Artificial Sequence
  Primer
aaacccgggctccagttctcctgcactctg

SEQ ID NO: 1049 - DNA, 47 bp, Artificial Sequence
  Primer
aaacccgggttacatagtattagtatatcttctcagtcttatgctac

SEQ ID NO: 1050 - DNA, 30 bp, Artificial Sequence
  Primer
aaacccgggttattgcttgtccctgcttcc

SEQ ID NO: 1051 - DNA, 39 bp, Artificial Sequence
  Primer
aaagagctcctagtcgttggtttagcaagtaaattacac

SEQ ID NO: 1052 - DNA, 30 bp, Artificial Sequence
  Primer
aaagagctcgctactcccactcgtactcag

SEQ ID NO: 1053 - DNA, 31 bp, Artificial Sequence
  Primer
aaaggatccaaagcagaccaatagcgaacac

SEQ ID NO: 1054 - DNA, 31 bp, Artificial Sequence
  Primer
aaaggatccaaattccaactttcccttccag

SEQ ID NO: 1055 - DNA, 31 bp, Artificial Sequence
  Primer
aaaggatccaacatacaggacaggcttgagg

SEQ ID NO: 1056 - DNA, 31 bp, Artificial Sequence
  Primer
aaaggatccaagacaccaccatttcacattg

SEQ ID NO: 1057 - DNA, 31 bp, Artificial Sequence
  Primer
aaaggatccaagagactgcttggtgaagtcg

SEQ ID NO: 1058 - DNA, 28 bp, Artificial Sequence
  Primer
aaaggatccaagccatcagcccatcaac

SEQ ID NO: 1059 - DNA, 31 bp, Artificial Sequence
  Primer
aaaggatccaagtccagctatcaccaaccag

SEQ ID NO: 1060 - DNA, 31 bp, Artificial Sequence
  Primer
aaaggatccacagcaacccagtgatcaattc

SEQ ID NO: 1061 - DNA, 31 bp, Artificial Sequence
  Primer
aaaggatccaccattgtccaaagaaccagac

SEQ ID NO: 1062 - DNA, 28 bp, Artificial Sequence
  Primer
aaaggatccacctggaggagaggacagc

SEQ ID NO: 1063 - DNA, 28 bp, Artificial Sequence
  Primer
aaaggatccactccaatcccaacacagc

SEQ ID NO: 1064 - DNA, 29 bp, Artificial Sequence
  Primer
aaaggatccactctcctgaaaccagcgtg

SEQ ID NO: 1065 - DNA, 31 bp, Artificial Sequence
  Primer
aaaggatccagagatgtctattggagccagc

SEQ ID NO: 1066 - DNA, 31 bp, Artificial Sequence
  Primer
aaaggatccagagcagagctacttcaggcag

SEQ ID NO: 1067 - DNA, 31 bp, Artificial Sequence
  Primer
aaaggatccagatcgatcgagtcagctcaag

SEQ ID NO: 1068 - DNA, 30 bp, Artificial Sequence
  Primer
aaaggatccagcactcgcttcacttctctg

SEQ ID NO: 1069 - DNA, 28 bp, Artificial Sequence
  Primer
aaaggatccagcccatcaacaccatgtc

SEQ ID NO: 1070 - DNA, 31 bp, Artificial Sequence
  Primer
aaaggatccagctagcacacacatcgtcttg

SEQ ID NO: 1071 - DNA, 29 bp, Artificial Sequence
  Primer
aaaggatccaggaaggtggggaaggaaac

SEQ ID NO: 1072 - DNA, 30 bp, Artificial Sequence
  Primer
aaaggatccattccggtgggtaagacagag

SEQ ID NO: 1073 - DNA, 28 bp, Artificial Sequence
  Primer
aaaggatccattgcgaagagccgaagac

SEQ ID NO: 1074 - DNA, 30 bp, Artificial Sequence
  Primer
aaaggatccatttaggagcaccgcagaaac

SEQ ID NO: 1075 - DNA, 36 bp, Artificial Sequence
  Primer
aaaggatccatttagggatgttatacaatgtgcatc

SEQ ID NO: 1076 - DNA, 29 bp, Artificial Sequence
  Primer
aaaggatcccacgcacttgcaaagaactc

SEQ ID NO: 1077 - DNA, 31 bp, Artificial Sequence
  Primer
aaaggatcccacgcagatctcgatcactaac

SEQ ID NO: 1078 - DNA, 31 bp, Artificial Sequence
  Primer
aaaggatcccagcttgacaaactccactagc

SEQ ID NO: 1079 - DNA, 31 bp, Artificial Sequence
  Primer
aaaggatcccaggcagcttacaaggagaaag

SEQ ID NO: 1080 - DNA, 31 bp, Artificial Sequence
  Primer
aaaggatcccagtcacccacaaccaattagc

SEQ ID NO: 1081 - DNA, 31 bp, Artificial Sequence
  Primer
aaaggatcccatgatcagactgtagccatgc

SEQ ID NO: 1082 - DNA, 30 bp, Artificial Sequence
  Primer
aaaggatccccacacctctgatctgctctg

SEQ ID NO: 1083 - DNA, 31 bp, Artificial Sequence
  Primer
aaaggatccccatggcagacatgttgtagag

SEQ ID NO: 1084 - DNA, 31 bp, Artificial Sequence
  Primer
aaaggatcccctcacgaagagctaagcaatc

SEQ ID NO: 1085 - DNA, 33 bp, Artificial Sequence
  Primer
aaaggatccccttacttagacaaggaagcaacg

SEQ ID NO: 1086 - DNA, 31 bp, Artificial Sequence
  Primer
aaaggatcccgctcgaatcattagctagcag

SEQ ID NO: 1087 - DNA, 31 bp, Artificial Sequence
  Primer
aaaggatcccggaaacgtgcacactacatac

SEQ ID NO: 1088 - DNA, 29 bp, Artificial Sequence
  Primer
aaaggatccctagacgcacctccaactgc

SEQ ID NO: 1089 - DNA, 29 bp, Artificial Sequence
  Primer
aaaggatccctcccagcttgacaaactcc

SEQ ID NO: 1090 - DNA, 30 bp, Artificial Sequence
  Primer
aaaggatcccttcaataacccagtcggcag

SEQ ID NO: 1091 - DNA, 31 bp, Artificial Sequence
  Primer
aaaggatccctttctttcattccctgtcgtg

SEQ ID NO: 1092 - DNA, 28 bp, Artificial Sequence
  Primer
aaaggatccgaaaccacagccgcttctg

SEQ ID NO: 1093 - DNA, 32 bp, Artificial Sequence
  Primer
aaaggatccgaagagaagagaggctaaccacc

SEQ ID NO: 1094 - DNA, 31 bp, Artificial Sequence
  Primer
aaaggatccgagacagatacgttcgcagatg

SEQ ID NO: 1095 - DNA, 31 bp, Artificial Sequence
  Primer
aaaggatccgcacacctagactagacgcacc

SEQ ID NO: 1096 - DNA, 30 bp, Artificial Sequence
  Primer
aaaggatccgcagaaacaacaatggagatg

SEQ ID NO: 1097 - DNA, 29 bp, Artificial Sequence
  Primer
aaaggatccgccagggatacttcatggac

SEQ ID NO: 1098 - DNA, 28 bp, Artificial Sequence
  Primer
aaaggatccgccgcaagagaggagagag

SEQ ID NO: 1099 - DNA, 28 bp, Artificial Sequence
  Primer
aaaggatccgccgtctgcttctcatcac

SEQ ID NO: 1100 - DNA, 31 bp, Artificial Sequence
  Primer
aaaggatccggcagcagcaagaatagttgag

SEQ ID NO: 1101 - DNA, 31 bp, Artificial Sequence
  Primer
aaaggatccgtcatatacagctccagcctcc

SEQ ID NO: 1102 - DNA, 31 bp, Artificial Sequence
  Primer
aaaggatccgtccactttctagctacgcacc

SEQ ID NO: 1103 - DNA, 31 bp, Artificial Sequence
  Primer
aaaggatccgttcctcggttcctaagtcagc

SEQ ID NO: 1104 - DNA, 30 bp, Artificial Sequence
  Primer
aaaggatccgtttctgggttggatctctcg

SEQ ID NO: 1105 - DNA, 32 bp, Artificial Sequence
  Primer
aaaggatcctaagtcagcagggtttgttcatc

SEQ ID NO: 1106 - DNA, 31 bp, Artificial Sequence
  Primer
aaaggatcctatttcccatcatctgtcggag

SEQ ID NO: 1107 - DNA, 28 bp, Artificial Sequence
  Primer
aaaggatcctcaaagcctcgctcgaatc

SEQ ID NO: 1108 - DNA, 36 bp, Artificial Sequence
  Primer
aaaggatcctcacaagaacattactgtgaaaggtag

SEQ ID NO: 1109 - DNA, 31 bp, Artificial Sequence
  Primer
aaaggatcctctccgtccgttctaacttctg

SEQ ID NO: 1110 - DNA, 31 bp, Artificial Sequence
  Primer
aaaggatcctgacaaccagaatgaagtcagc

SEQ ID NO: 1111 - DNA, 27 bp, Artificial Sequence
  Primer
aaaggatcctgcacacgcaaagattcc

SEQ ID NO: 1112 - DNA, 31 bp, Artificial Sequence
  Primer
aaaggatcctgctccaagccatacagtacac

SEQ ID NO: 1113 - DNA, 29 bp, Artificial Sequence
  Primer
aaaggatcctgggcttctctcaccaacac

SEQ ID NO: 1114 - DNA, 30 bp, Artificial Sequence
  Primer
aaaggatcctggtttcgtgtgatcaagagc

SEQ ID NO: 1115 - DNA, 31 bp, Artificial Sequence
  Primer
aaaggatccttcacgagccagaagagaagag

SEQ ID NO: 1116 - DNA, 32 bp, Artificial Sequence
  Primer
aaaggatccttccagatttcttgctagtccac

SEQ ID NO: 1117 - DNA, 31 bp, Artificial Sequence
  Primer
aaaggtaccaaccctgtcgatcctgtaactg

SEQ ID NO: 1118 - DNA, 30 bp, Artificial Sequence
  Primer
aaaggtaccacacgcatatatccagcttgc

SEQ ID NO: 1119 - DNA, 31 bp, Artificial Sequence
  Primer
aaaggtaccacaggaggagagaaagttcgag

SEQ ID NO: 1120 - DNA, 31 bp, Artificial Sequence
  Primer
aaaggtaccaccctacgttaaggcacacaag

SEQ ID NO: 1121 - DNA, 32 bp, Artificial Sequence
  Primer
aaaggtaccacgaaggcactgacagctactac

SEQ ID NO: 1122 - DNA, 30 bp, Artificial Sequence
  Primer
aaaggtaccccacagatagagcagcaggac

SEQ ID NO: 1123 - DNA, 31 bp, Artificial Sequence
  Primer
aaaggtacccctttctcctgtaaccatgcac

SEQ ID NO: 1124 - DNA, 31 bp, Artificial Sequence
  Primer
aaaggtaccgcaatgcctaatatagcgaacc

SEQ ID NO: 1125 - DNA, 31 bp, Artificial Sequence
  Primer
aaaggtaccgctaacgcaaggctactttacc

SEQ ID NO: 1126 - DNA, 31 bp, Artificial Sequence
  Primer
aaaggtacctgcagctaatcctacaccacac

SEQ ID NO: 1127 - DNA, 29 bp, Artificial Sequence
  Primer
aaagtcgacaacttccggctatgtgcttg

SEQ ID NO: 1128 - DNA, 42 bp, Artificial Sequence
  Primer
aaagtcgaccagagagatatatagagagagagagagcagtag

SEQ ID NO: 1129 - DNA, 30 bp, Artificial Sequence
  Primer
aaagtcgacgcaacgccttcctcatcatac

The invention claimed is:

1. A method for producing a population of plants each having an enhanced resistance to *Fusarium verticillioides*, said method comprising the steps of: a. genetically enhancing the expression and/or activity of a polypeptide having the amino acid sequence set forth in SEQ ID NO:573 within at least one cell of each plant of a plant population by introducing into the at least one cell of the plant or part thereof an exogenous polynucleotide encoding the polypeptide as to produce a genetically engineered plant population; b. inoculating each plant of the genetically engineered plant population with the *Fusarium verticillioides*; and c. selecting plants showing an enhanced resistance to said *Fusarium verticillioides* compared to a control plant or to a predetermined resistance score value, wherein the control plant is a plant not manipulated to have enhanced expression and/or activity of said polypeptide; thereby producing a population of genetically engineered plants having enhanced resistance to said *Fusarium verticillioides*.

2. A method for selecting a plant having an enhanced resistance to *Fusarium verticillioides*, said method comprising the steps of: a. providing a plurality of plants each comprising at least one cell genetically modulated to have enhanced expression and/or activity of a polypeptide having the amino acid sequence set forth in SEQ ID NO:573 by introducing into the at least one cell an exogenous polynucleotide encoding the polypeptide; b. inoculating the plurality of plants with *Fusarium verticillioides*; and c. selecting plants showing an enhanced resistance to said *Fusarium verticillioides* compared to a control plant or to a pre-determined resistance score value, wherein the control plant is a plant not manipulated to have enhanced expression and/or activity of said polypeptide and grown under the same conditions; thereby selecting a plant having enhanced resistance to said *Fusarium verticillioides*.

* * * * *